(12) United States Patent
Amann et al.

(10) Patent No.: US 10,392,445 B2
(45) Date of Patent: Aug. 27, 2019

(54) TUMOR NECROSIS FACTOR (TNF) FAMILY LIGAND TRIMER-CONTAINING ANTIGEN-BINDING MOLECULES

(71) Applicant: Hoffmann-La Roche Inc., Little Falls, NJ (US)

(72) Inventors: Maria Amann, Duebendorf (CH); Peter Bruenker, Hittnau (CH); Christina Claus, Ennetbaden (CH); Claudia Ferrara Koller, Zug (CH); Sandra Grau-Richards, Birmensdorf (CH); Christian Klein, Bonstetten (CH); Viktor Levitski, Schlieren (CH); Ekkehard Moessner, Kreuzlingen (CH); Joerg Thomas Regula, Munich (DE); Pablo Umana, Wollerau (CH)

(73) Assignee: Hoffmann-La Roche Inc., Little Falls, NJ (US)

(*) Notice: Subject to any disclaimer, the term of this patent is extended or adjusted under 35 U.S.C. 154(b) by 173 days.

(21) Appl. No.: 15/067,024

(22) Filed: Mar. 10, 2016

(65) Prior Publication Data
US 2016/0200833 A1 Jul. 14, 2016

Related U.S. Application Data

(63) Continuation of application No. PCT/EP2015/076528, filed on Nov. 13, 2015.

(30) Foreign Application Priority Data

Nov. 14, 2014 (EP) .................................. 14193260
Sep. 3, 2015 (EP) .................................. 15183736
Oct. 2, 2015 (EP) .................................. 15188142

(51) Int. Cl.
| | |
|---|---|
| *C07K 16/40* | (2006.01) |
| *C07K 16/28* | (2006.01) |
| *C07K 14/705* | (2006.01) |
| *A61K 39/395* | (2006.01) |
| *C07K 16/30* | (2006.01) |
| *A61K 38/00* | (2006.01) |

(52) U.S. Cl.
CPC ............ *C07K 16/40* (2013.01); *A61K 39/395* (2013.01); *C07K 14/70575* (2013.01); *C07K 16/2803* (2013.01); *C07K 16/2815* (2013.01); *C07K 16/3007* (2013.01); *A61K 38/00* (2013.01); *C07K 2317/33* (2013.01); *C07K 2317/35* (2013.01); *C07K 2317/522* (2013.01); *C07K 2317/524* (2013.01); *C07K 2317/526* (2013.01); *C07K 2317/565* (2013.01); *C07K 2317/60* (2013.01); *C07K 2317/92* (2013.01); *C07K 2319/30* (2013.01); *C07K 2319/33* (2013.01)

(58) Field of Classification Search
CPC ............ C07K 16/2803; C07K 16/2815; C07K 16/3007; C07K 16/40; C07K 14/70575; C07K 2317/33; C07K 2317/35; C07K 2317/522; C07K 2317/524; C07K 2317/526; C07K 2317/565; C07K 2317/60; C07K 2317/92; C07K 2319/30; C07K 2319/33; A61K 39/395; A61K 38/00
See application file for complete search history.

(56) References Cited

U.S. PATENT DOCUMENTS

| | | | |
|---|---|---|---|
| 5,731,168 | A | 3/1998 | Carter et al. |
| 5,821,333 | A | 10/1998 | Carter et al. |
| 6,737,056 | B1 | 5/2004 | Presta |
| 8,552,024 | B2 | 10/2013 | Ackermann et al. |
| 8,945,571 | B2 | 2/2015 | Hosse et al. |
| 8,969,526 | B2 | 3/2015 | Baehner et al. |
| 9,011,847 | B2 | 4/2015 | Bacac et al. |
| 9,266,938 | B2 | 2/2016 | Ast et al. |
| 9,346,872 | B2 | 5/2016 | Duerner et al. |
| 9,481,730 | B2 | 11/2016 | Bruenker et al. |
| 2013/0287802 | A1 | 10/2013 | Govindappa et al. |
| 2014/0044674 | A1 | 2/2014 | Duerner et al. |
| 2014/0370019 | A1 | 12/2014 | Bruenker et al. |
| 2015/0218244 | A1 | 8/2015 | Emrich et al. |
| 2015/0315296 | A1 | 11/2015 | Schaefer et al. |
| 2016/0060356 | A1 | 3/2016 | Bacac et al. |
| 2016/0060357 | A1 | 3/2016 | Bacac et al. |
| 2016/0159917 | A1 | 6/2016 | Bruenker et al. |
| 2016/0340399 | A1 | 11/2016 | Amann et al. |
| 2016/0340413 | A1 | 11/2016 | Duerner et al. |

(Continued)

FOREIGN PATENT DOCUMENTS

| | | |
|---|---|---|
| AU | 2011 265 482 B2 | 8/2013 |
| AU | 2013263717 B2 | 11/2013 |

(Continued)

OTHER PUBLICATIONS

D. Müller et al., Journal of Immunotherapy 31(8):714-722 (Oct. 1, 2008).

(Continued)

*Primary Examiner* — Robert S Landsman

(57) ABSTRACT

The invention relates to novel TNF family ligand trimer-containing antigen binding molecules comprising (a) at least one moiety capable of specific binding to a target cell antigen and (b) a first and a second polypeptide that are linked to each other by a disulfide bond, characterized in that the first polypeptide comprises two ectodomains of a TNF ligand family member or fragments thereof that are connected to each other by a peptide linker and in that the second polypeptide comprises only one ectodomain of said TNF ligand family member or a fragment thereof.

39 Claims, 86 Drawing Sheets

Specification includes a Sequence Listing.

(56) References Cited

U.S. PATENT DOCUMENTS

| | | | |
|---|---|---|---|
| 2017/0114141 | A1 | 4/2017 | Amann et al. |
| 2017/0129962 | A1 | 5/2017 | Regula et al. |
| 2017/0247467 | A1 | 8/2017 | Amann et al. |

FOREIGN PATENT DOCUMENTS

| | | |
|---|---|---|
| EP | 1736482 | 12/2006 |
| WO | 2004/039841 | 5/2004 |
| WO | 200469876 A2 | 8/2004 |
| WO | 2007/014744 | 2/2007 |
| WO | 2008/022152 A2 | 2/2008 |
| WO | 200900538 A1 | 12/2008 |
| WO | 2009/040550 A1 | 4/2009 |
| WO | 2010/010051 A1 | 1/2010 |
| WO | 2011/109789 | 9/2011 |
| WO | 2011/020783 A2 | 2/2012 |
| WO | 2012/020006 | 2/2012 |
| WO | 2012/130471 A1 | 10/2012 |
| WO | 2014/161845 A1 | 10/2014 |
| WO | 2014/180754 | 11/2014 |
| WO | 2015/184203 A1 | 12/2015 |
| WO | 2015183902 A1 | 12/2015 |
| WO | 2016075278 | 5/2016 |
| WO | 2016156291 | 10/2016 |

OTHER PUBLICATIONS

E. Bremer, ISRN Onconlogy 176(2):1-26 (Jan. 1, 2013).
Kermer et al., Mol Cancer Ther 13(1):12-121 ( 2014).
N. Hornig et al., Journal of Immunotherapy 35(5):418-429 (Jun. 1, 2012).
N. Zhang et al., Clinical Cancer Research 13(9):2758-2767 (Jan. 28, 2010).
Written Opinion of the International Searching Authority PCT/EP2015/076528 (dated Mar. 2016).
Aggarwal et al., "Signalling pathways of the TNF superfamily: a double-edged sword" Nat Rev Immunol 3(9):745-756 (Sep. 2003).
Ascierto P. et al., "Clinical Experiences With Anti-CD137 and Anti-PD1 Therapeutic Antibodies" Seminars in Oncology 27(5):508-516 (Oct. 2010).
Banner et al., "Crystal Structure of the Soluble Human 55 kd TNF Receptor-Human TNFβ Complex: Implications for TNF Receptor Activation" Cell 73:431-122 ( 1993).
Bauer et al., "Targeted Bioactivity of Membrane-Anchored TNF by an Antibody-Derived TNF Fusion Protein" J Immunol 172(6):3930-3939 ( 2004).
Bodmer et al. et al., "The molecular architecture of the TNF superfamily" Trends Biochem Sci 27:19-26 ( 2002).
Broll et al., "CD137 Expression in Tumor Vessel Walls High Correlation With Malignant Tumors" Am. J. Chin. Pathol 115:543-549 ( 2001).
Buechele et al., "4-1BB ligand modulates direct and Rituximab-induced NK-cell reactivity in chronic lymphocytic leukemia" J Immunol 42:737-748 ( 2012).
Choi et al., "4-1BB Functions as a Survival Factor in Dendritic Cells" J Immunol 182:4107-4115 ( 2009).
Cuadros C. et al., "Vaccination with dendritic cells pulsed with apoptotic tumors in combination with anti-OX40 and anti-4-1BB monoclonal antibodies induces T cell-mediated protective immunity in Her-2/neu transgenic mice." Int J Cancer 116:934-943 ( 2005).
Curran M. A. et al., "Combination CTLA-4 blockade and 4-1BB activation enhances tumor rejection by increasing T-cell infiltration, proliferation, and cytokine production." PLoS One 6:e19499. ( 2011).
Diehl et al., "In Vivo Triggering Through 4-1BB Enables Th-Independent Priming of CTL in the Presence of an Intact CD28 Costimulatory Pathway" J Immunol 168:3755-3762 ( 2002).
Dubrot et al., "Treatment with anti-CD137 mAbs causes intense accumulations of liver T cells without selective antitumor immunotherapeutic effects in this organ" Cancer Immunol Immunother 59:1223-1233 ( 2010).
Futagawa et al., "Expression and function of 4-1 BB and 4-1BB ligand on murine dendritic cells" International Immonology 14:275-286 ( 2002).
Gaugitsch et al., "A novel transiently expressed, integral membrane protein linked to cell activation. Molecular cloning via the rapid degradation signal AUUUA" J Biol Chem. 267(16):11267-11273 (Jun. 5, 1992).
Guo Z. et al., "Combined TIM-3 blockade and CD137 activation affords the long-term protection in a murine model of ovarian cancer." J Transl Med 11:215 ( 2013).
Heinisch et al., "CD137 activation abrogates granulocytemacrophage colony-stimulating factor-mediated anti-apoptosis in neutrophils" Eur. J. Immunol. 30:3441-3346 ( 2000).
Ju S.A. et al., "Eradication of established renal cell carcinoma by a combination of 5-fluorouracil and anti-4-1BB monoclonal antibody in mice." Int J Cancer 122:2784-2790. ( 2008).
Kienzle et al., "CD137 (ILA/4-1BB), expressed by primary human monocytes, induces monocyte activation and apoptosis of B lymphocytes" International Immonology 12:73-82 ( 2000).
Kim et al., "4-1BB Engagement Costimulates NKT Cell Activation and Exacerbates NKT Cell Ligand-Induced Airway Hyper-responsivenss and Inflammation" J Immunol 180:2062-2068 ( 2008).
Kim, Y. H. et al., "Mechanisms involved in synergistic anticancer effects of anti-4-1BB and cyclophosphamide therapy." Mol Cancer Ther 8:469-478 ( 2009).
Kwon et al., "cDNA sequences of two inducible T-cell genes" P Natl Acad Sci USA 86:1963-1967 ( 1989).
Lee et al., "Combinatorial therapy for liver metastatic colon cancer: dendritic cell vaccine and low-dose agonistic anti-4-1BB antibody costimulatory signal" J Surg Res 169:e43-50 ( 2011).
Levitsky V. et al., "The clonal composition of a peptide-specific oligoclonal CTL repertoire selected in response to persistent EBV infection is stable over time." J Immunol 161:594-601 ( 1998).
Li et al., "Inhibitory Fcγ Receptor Engagement Drives Adjuvant and Anti-Tumor Activities of Agonistic CD40 Antibodies" Science 333:1030-1034 ( 2011).
Lin et al., "Fc-dependent expression of CD137 on human NK cells: insights into agonistic effects of anti-CD137 monoclonal antibodies" Blood 112:699-707 ( 2008).
Melero et al., "Monoclonal Antibodies Against the 4-1BB T-cell Activation Molecule Eradicate Established Tumors" Nature Medicine 3(6):682-685 ( 1997).
Melero et al., "NK1.1 Cells Express 4-1BB (CDw137) Costimulatory Molecule and are Required for Tumor Immunity Elicited by Anti-4-1BB Monoclonal Antibodies" Cellular Immunology 190:167-172 ( 1998).
Merchant et al., "An efficient route to human bispecific IgG" Nat Biotechnol 16(7):677-681 ( 1998).
Morales-Kastresana, A. et al., "Combined immunostimulatory monoclonal antibodies extend survival in an aggressive transgenic hepatocellular carcinoma mouse model." Clin Cancer Res 19:6151-6162 ( 2013).
Mueller et al., "Activity of soluble OX40 ligand is enhanced by oligomerization and cell surface immobilization" FEBS J. 275:2296-2304 ( 2008).
Murillo et al., "In vivo depletion of DC impairs the anti-tumor effect of agonistic anti-CD137 mAb" Eur. J. Immunol. 39:2424-2436 ( 2009).
Narazaki et al., "CD137 agonist antibody prevents cancer recurrence: contribution of CD137 on both hematopoietic and nonhematopoietic cells" Blood 115:1941-1948 ( 2010).
Nishimoto, et al., "Costimulation of mast cells by 4-1BB, a member of the tumor necrosis factor receptor superfamily, with the high-affinity IgE receptor" Blood 106:4241-4248 ( 2005).
Olofsson, et al., "CD137 is Expressed in Human Atherosclerosis and Promotes Development of Plaque inflammation in Hypercholesterolemic Mice" Circulation 117:1292-1301 ( 2008).
Palazon er al., "Agonist Anti-CD 137 mAb Act on Tumor Endothelial Cells to Enhance Recruitment of Activated T Lymphocytes" Cancer Research 71:801-811 ( 2011).
Schwarz et al., "ILA, the Human 4-1BB Homologue, Is Inducible in Lymphoid and Other Cell Lineages" Blood 85:1043-1052 ( 1995).

(56) References Cited

OTHER PUBLICATIONS

Shao, Z. et al., "CD137 ligand, a member of the tumor necrosis factor family, regulates immune responses via reverse signal transduction." J Leukoc Biol 89:21-29 ( 2011).
Shi, W. et al., "Augmented antitumor effects of radiation therapy by 4-1BB antibody (BMS-69492) treatment." Anticancer Res 26:3445-3453 ( 2006).
Simeone et al., "Immunomodulating antibodies in the treatment of metastatic melanoma: The experience with anti- CTLA-4, anti-CD137, and anti-PD1" Journal of Immunotoxicology 9:241-247 ( 2012).
Snell et al., "T-cell intrinsic effects of GITR and 4-1BB during viral infection and cancer immunotherapy" Immunological Reviews 244:197-217 ( 2011).
Stagg et al., "Anti-ErbB-2 mAb therapy requires type I and II interferons and synergizes with anti-PD-1 or anti-CD137 mAb therapy" Proc. Nall. Acad. Sci. USA 108:7142-7147 ( 2011).
Teng et al., "CD1d-Based Combination Therapy Eradicates Established Tumors in Mice" J Immunol 183:1911-1920 ( 2009).
Von Kempis et al., "Differentiation-dependent and stimulus-specific expression of ILA, the human 4-1BB-homologue, in cells of mesenchymal origin" Osteoarthritis and Cartilage 5:394-406 ( 1997).
Wei, H. et al., "Combinatorial PD-1 bloackade and CD137 activation has therapeutic efficacy in murine cancer models and synergizes with cisplatin." PLoS One 8:e84927 ( 2013).
Wilcox et al., "Cutting Edge: Expression of Functional CD137 Receptor by Dendritic Cells" J Immunol 168:4262-4267 ( 2002).
Wilcox et al., "Ligatin of CD137 receptor prevents and reverses established anergy of CD8$^{+}$cytolytic T lymphocytes in vivo" Blood 103:177-184 ( 2004).
Zhang et al., "CD137 Promotes Proliferation and Survival of Human B Cells" J Immunol 184:787-795 ( 2010).
Baumann et al., "Functional expression of CD134 by neutrophils" Eur. J. Immunol. 34:2268-2275 ( 2004).
Bremer et al., "Targeting of the Tumor Necrosis Factor Receptor Superfamily for Cancer Immunotherapy" ISRN Oncology 2013:1-25 ( 2013).
Carter, "Bispecific human IgG by design" J Immunol Methods 248(1-2):7-15 (Feb. 1, 2001).
Croft et al., "The significance of OX40 and OX40L to T-cell biology and immune disease" Immunological Reviews 229:173-191, (2009).
Graff et al., "Directed evolution of an anti-carcinoembryonic antigen scFv with a 4-day monovalent dissociation half-time at 37 degrees C" Protein Eng. Des. Scl. 17(4):293-304 (Jun. 2004).
Hornig et al., "Evaluating combinations of costimulatory antibody-ligand fusion proteins for targeted cancer immunotherapy" Can Immunol Immunotherapy:1369-1380 (May 17, 2013).
Wyzgol et al., "Trimer Stabilization, Oligomerization, and Antibody-Mediated Cell Surface Immobilization Improve the Activity of Soluble Trimers of CD27L, CD40L, 41BBL, and Glucocorticoid-Induced TNF Receptor Ligand1" The Journal of Immunology 183:1851-1861 ( 2009).

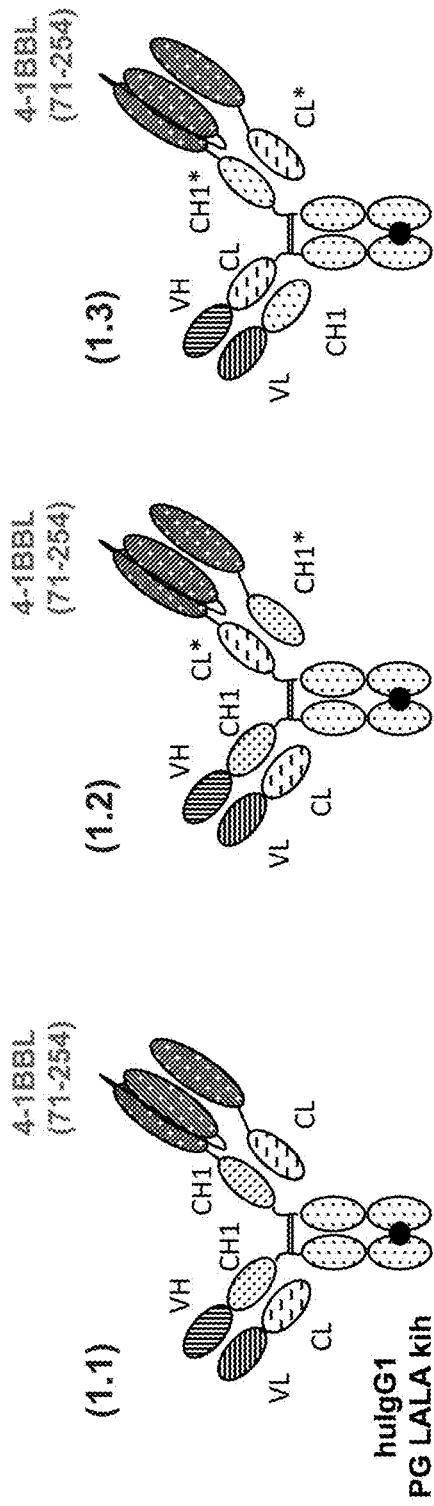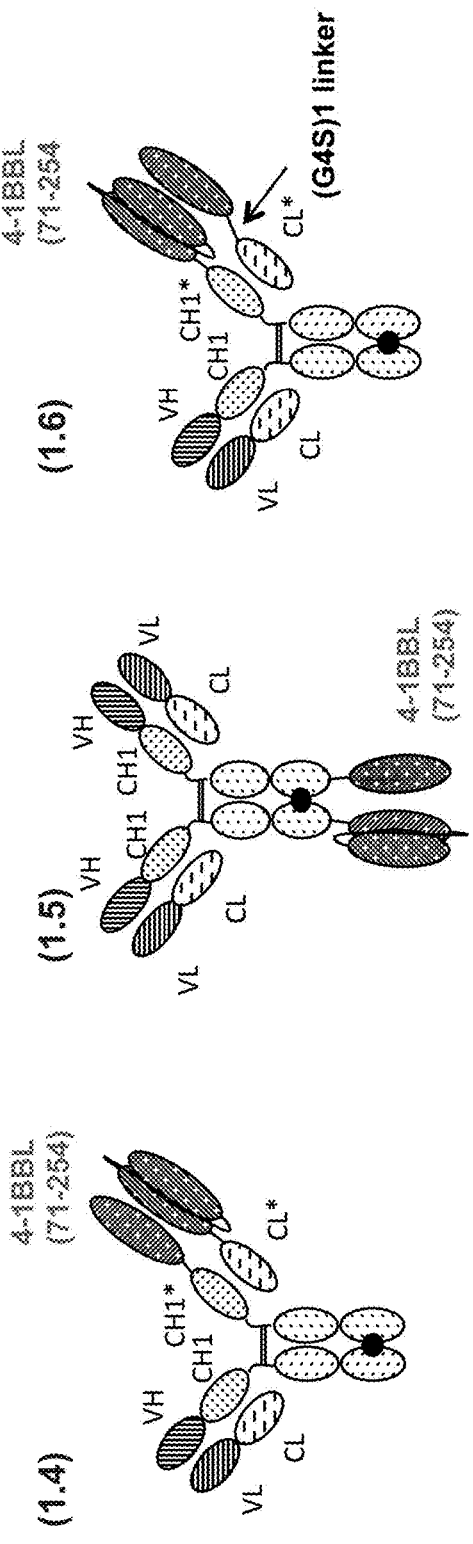

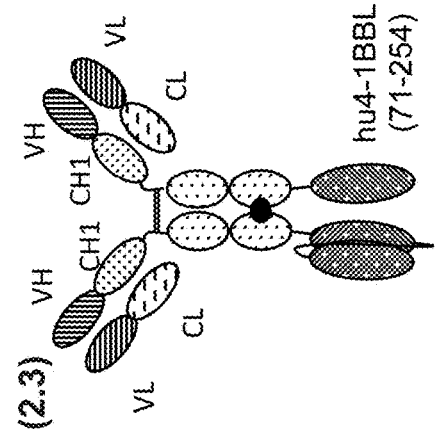
FIG. 4A
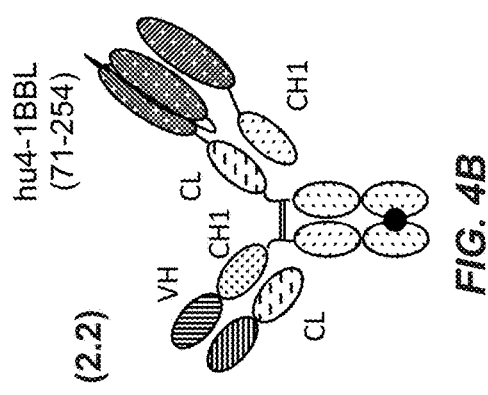
FIG. 4B
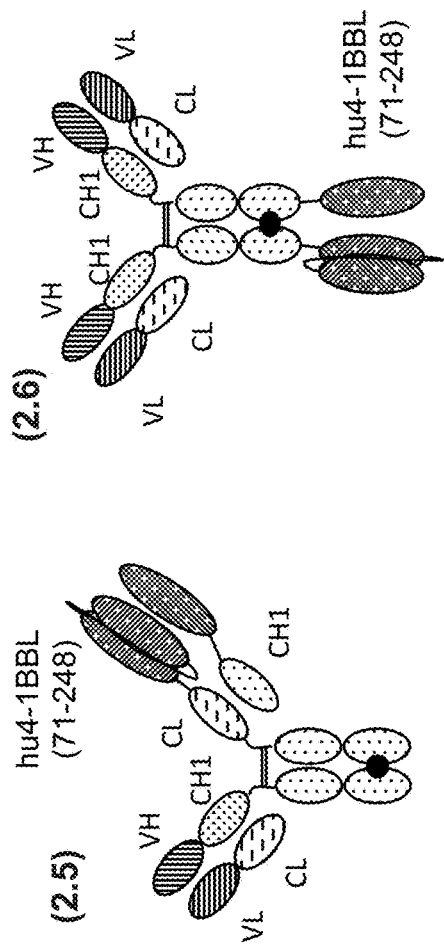
FIG. 4C
FIG. 4F
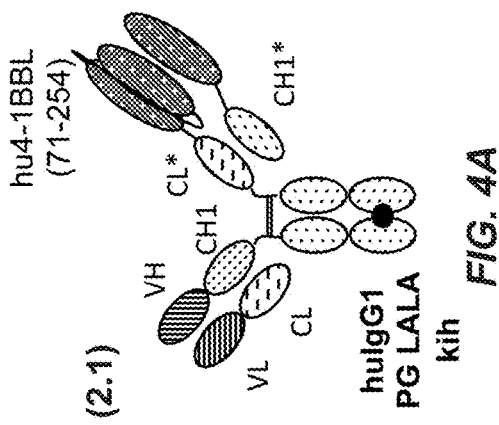
FIG. 4D
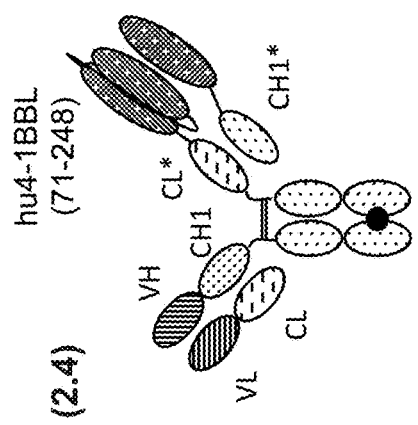
FIG. 4E

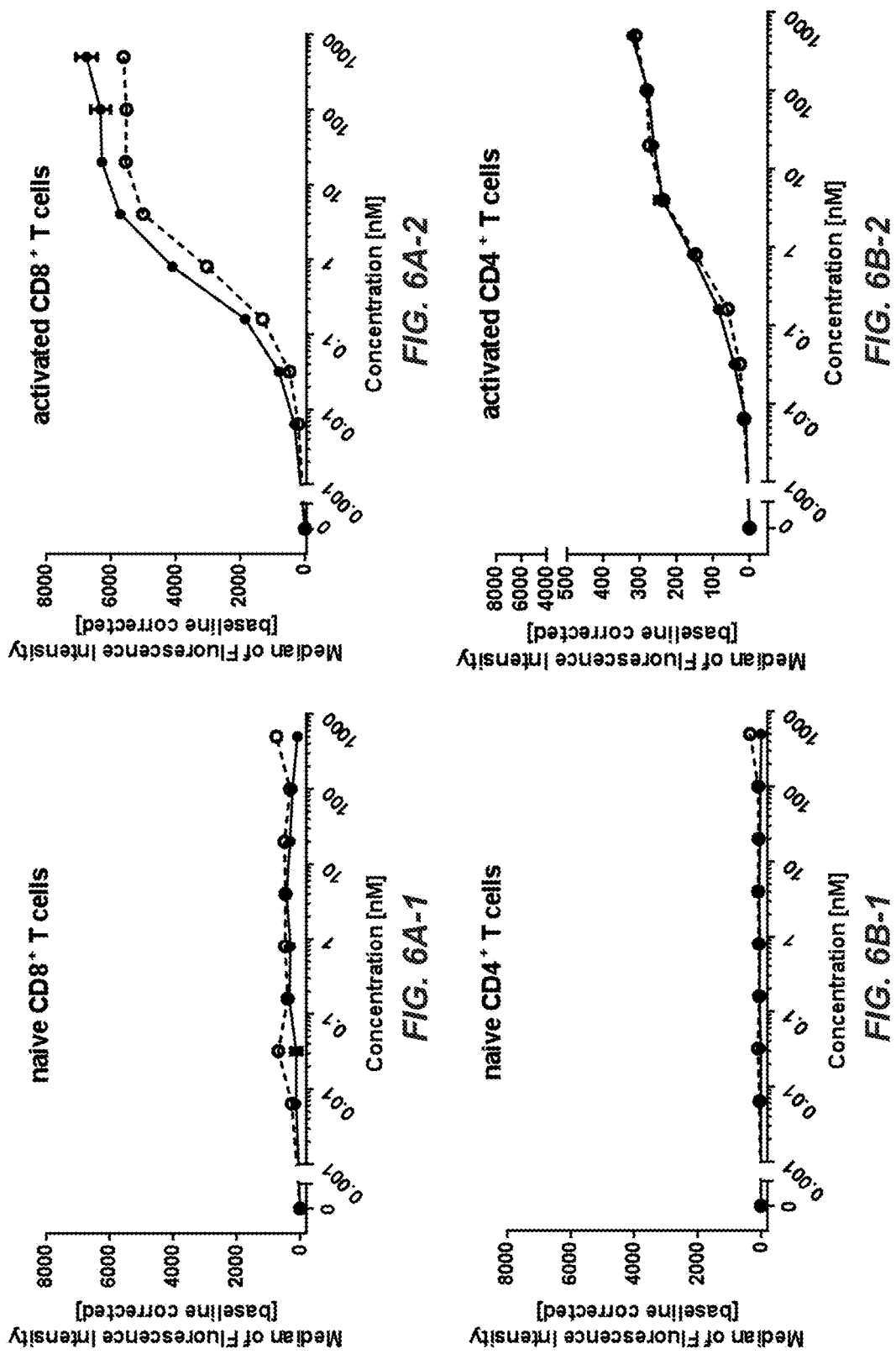

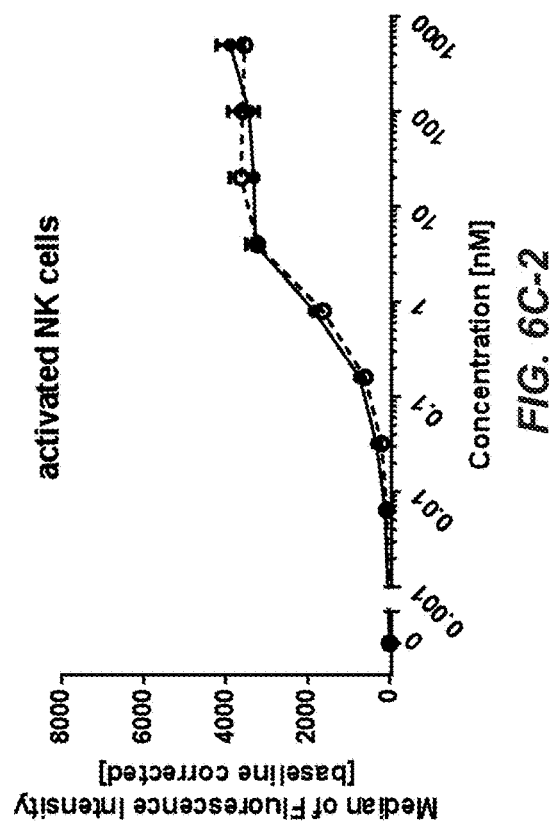
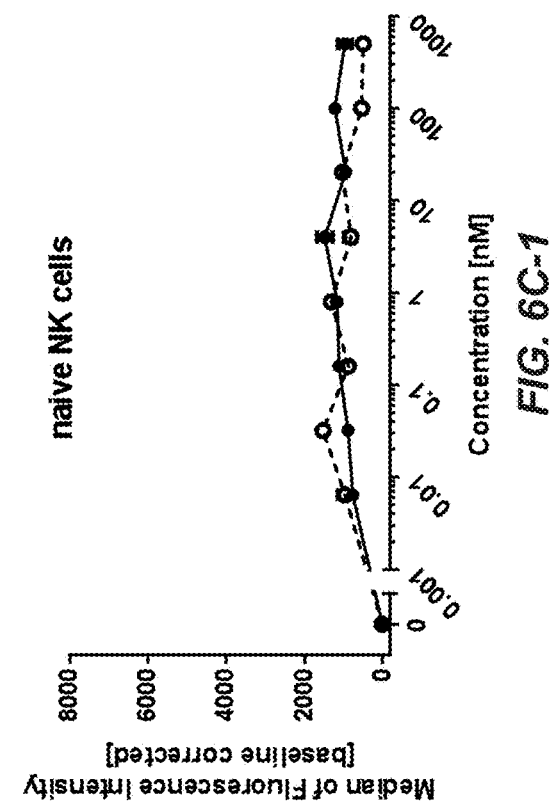
FIG. 6C-2
FIG. 6C-1

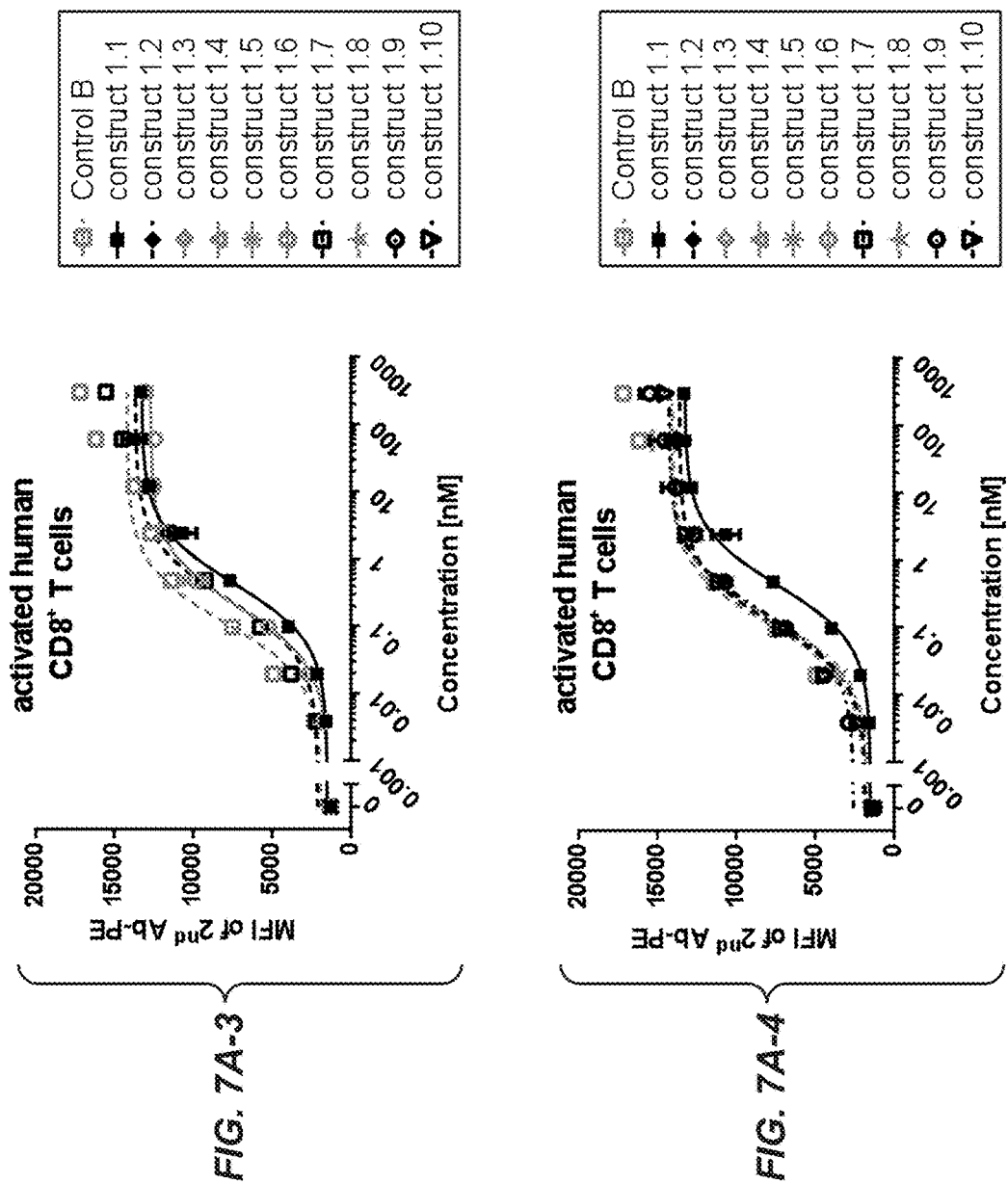

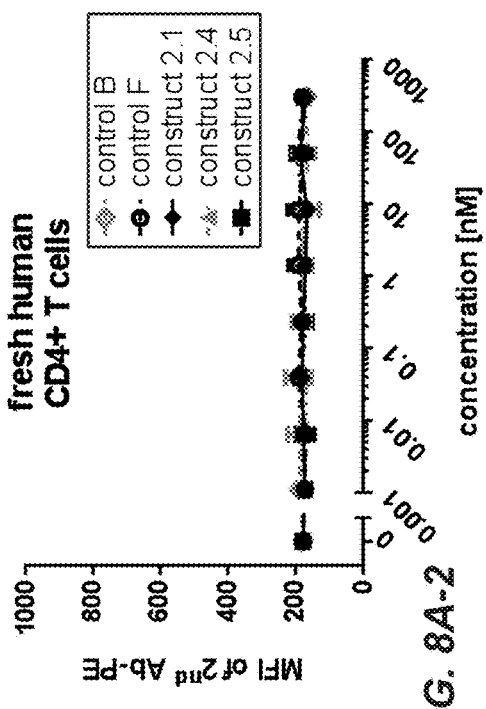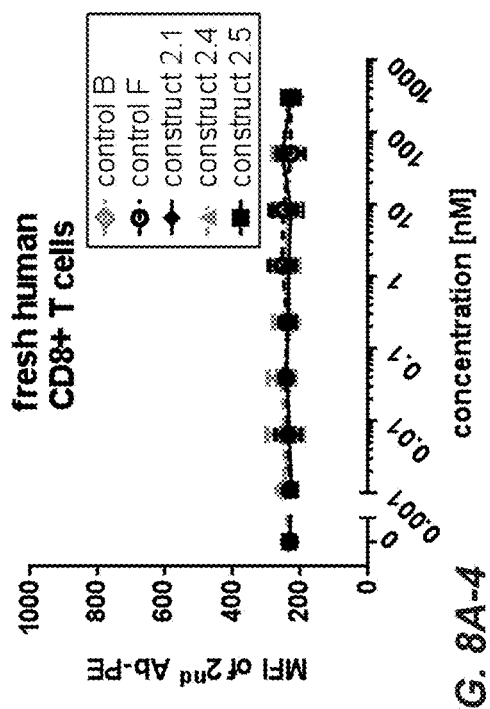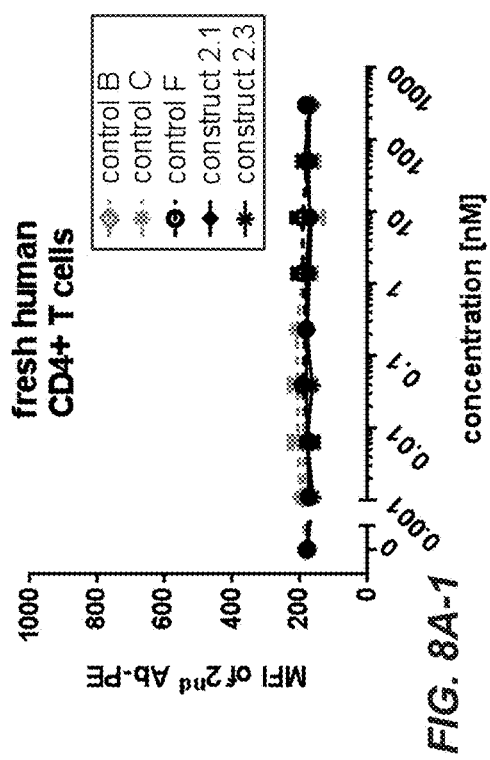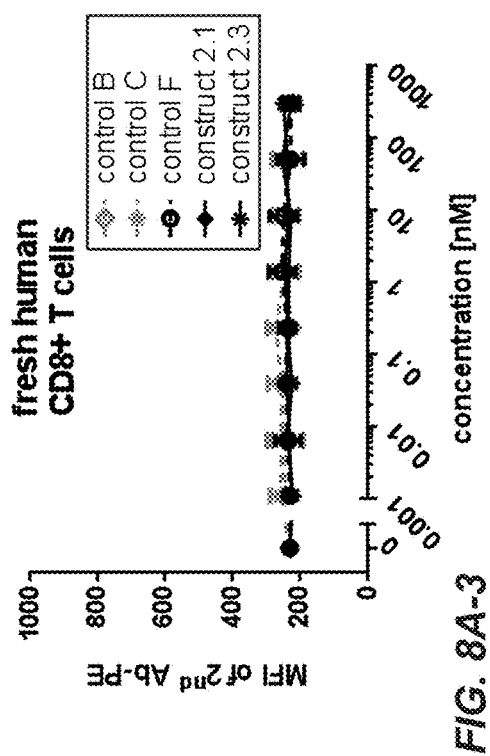
FIG. 8A-1  FIG. 8A-2  FIG. 8A-3  FIG. 8A-4

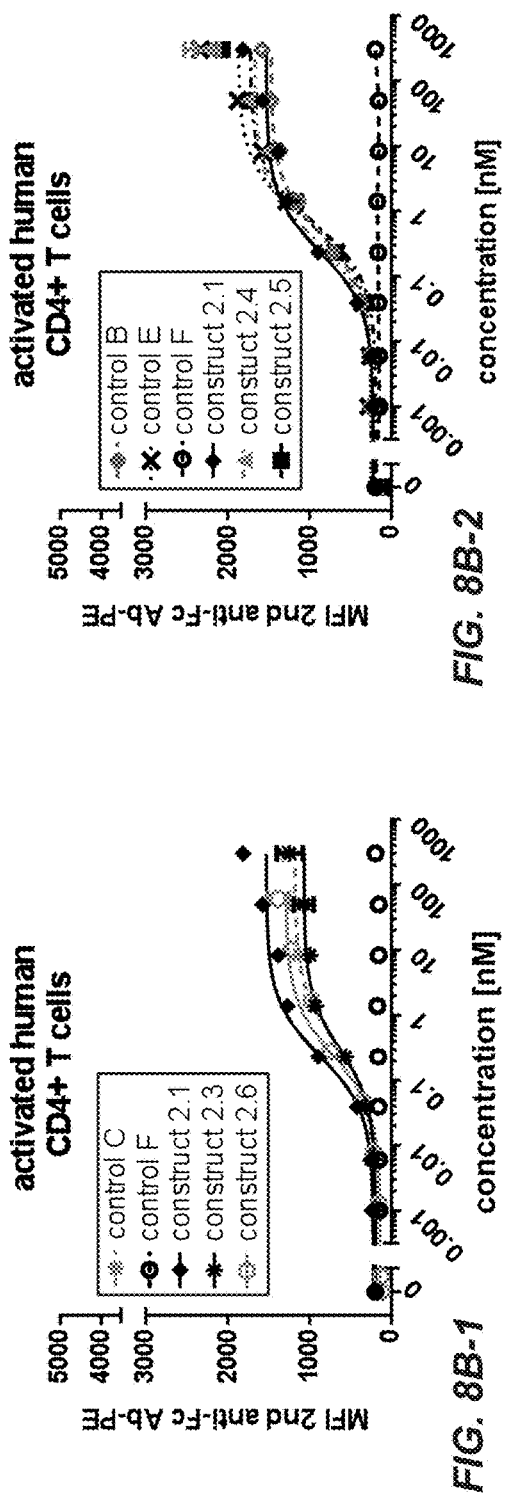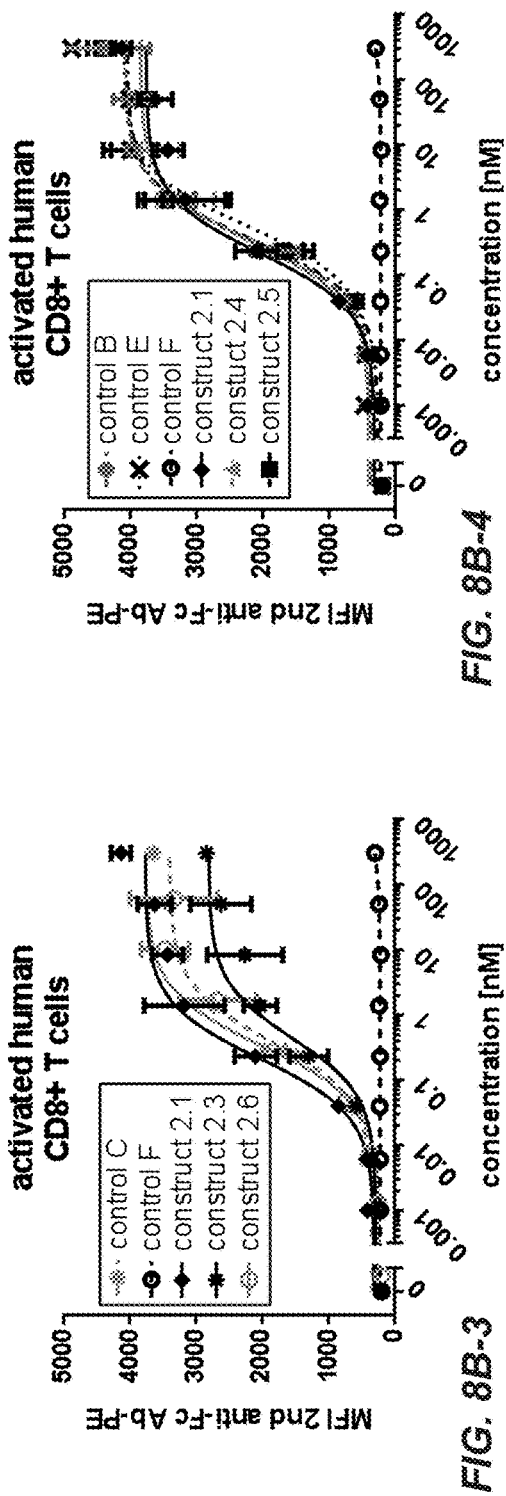
FIG. 8B-1
FIG. 8B-2
FIG. 8B-3
FIG. 8B-4

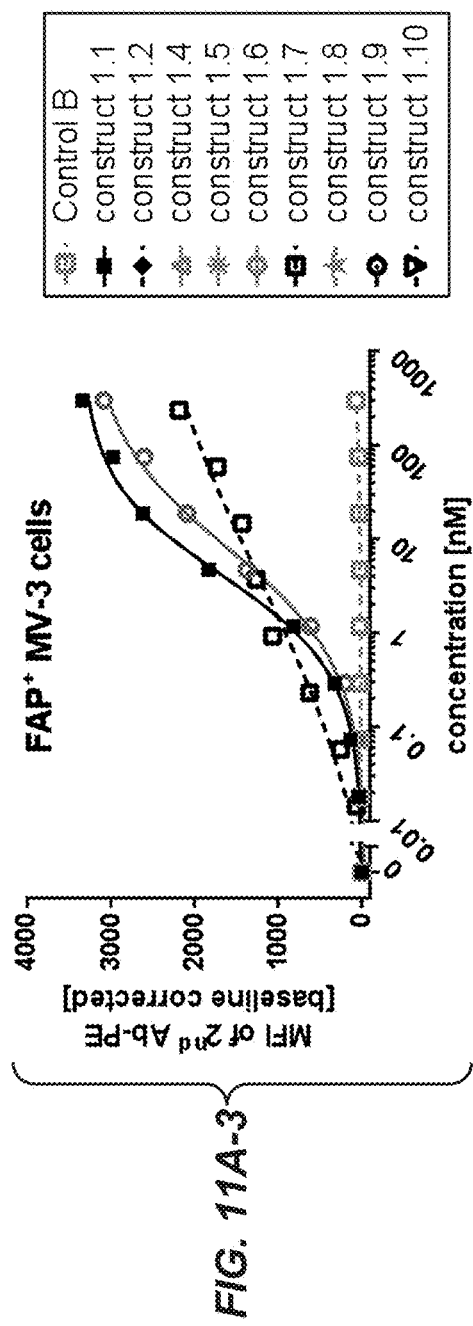
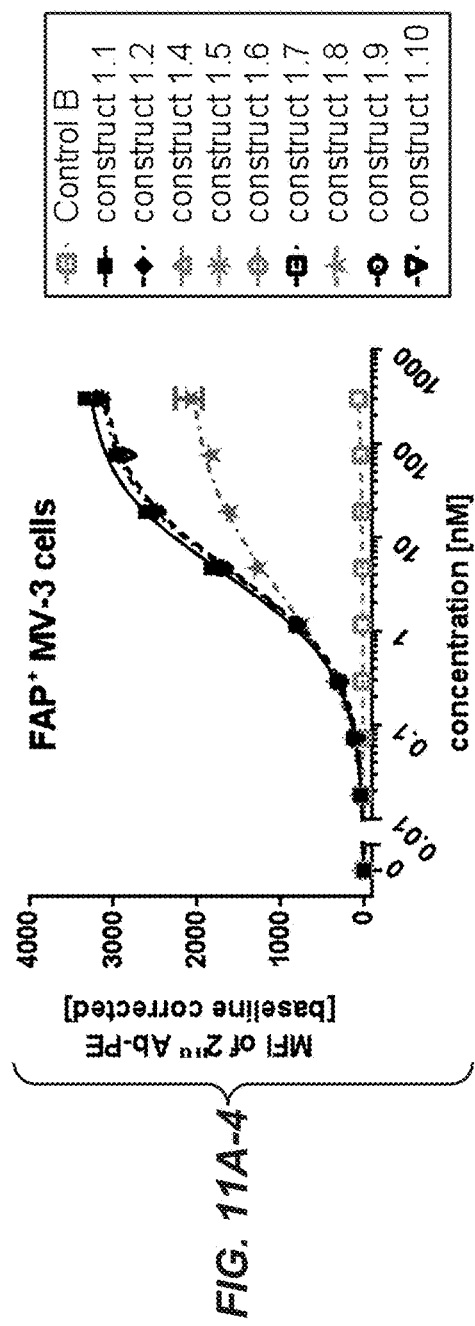
FIG. 11A-3
FIG. 11A-4

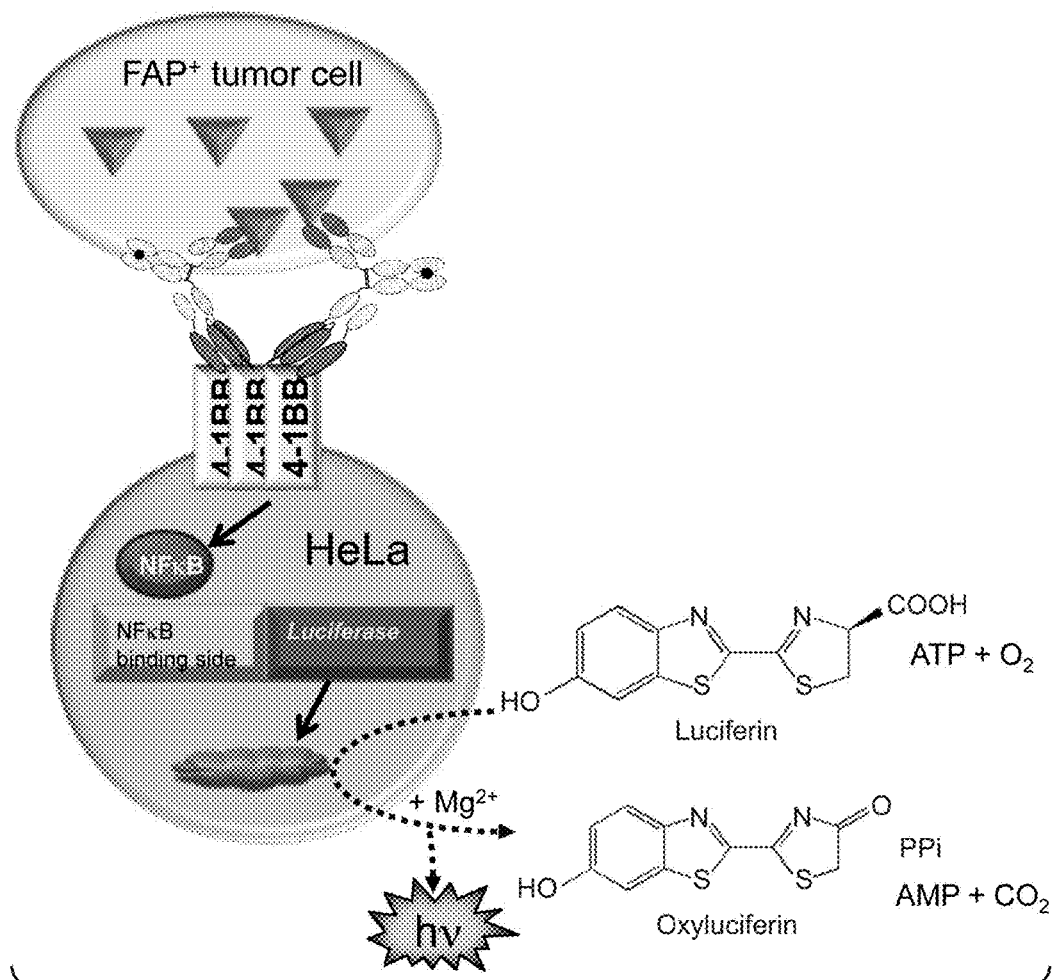
*FIG. 15A*
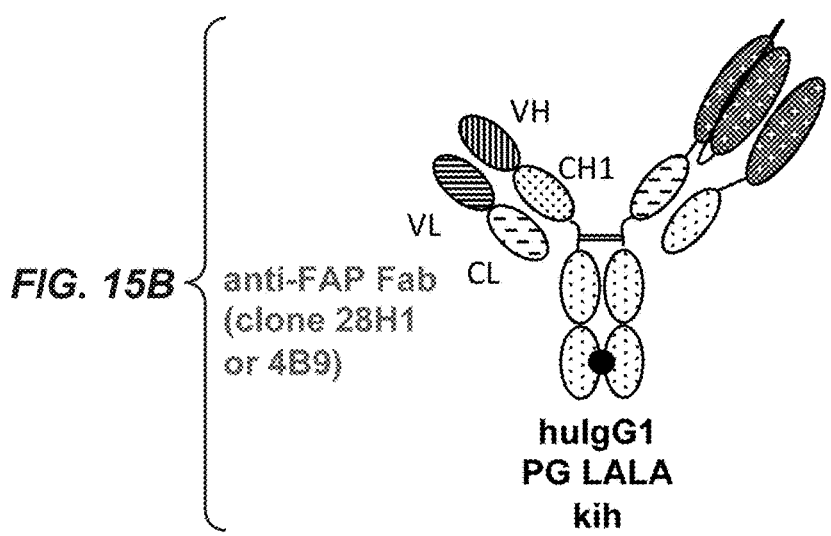
*FIG. 15B* anti-FAP Fab (clone 28H1 or 4B9)
huIgG1 PG LALA kih

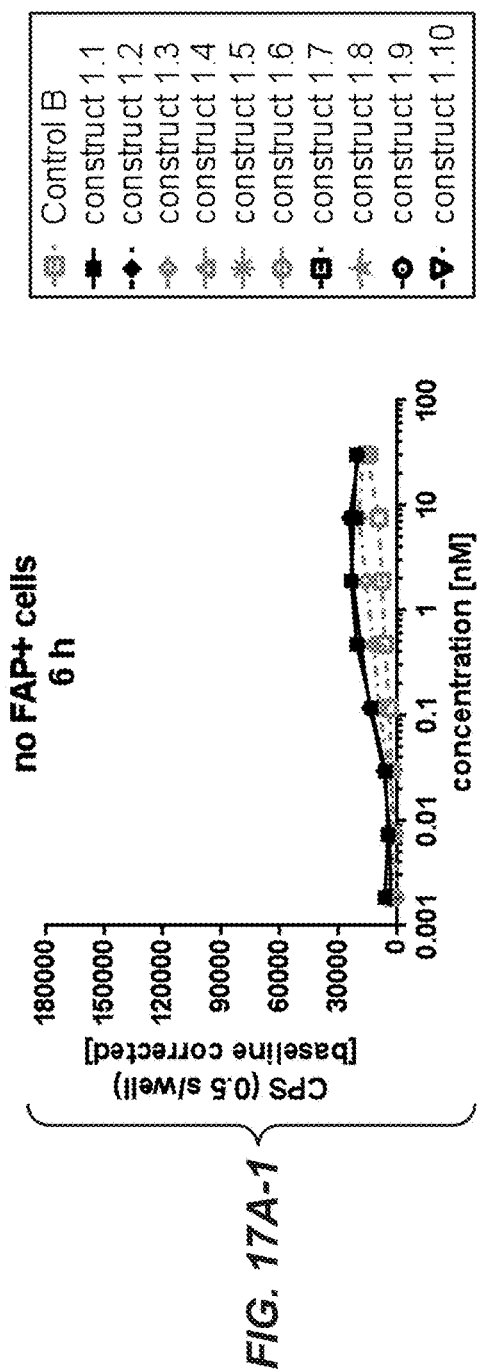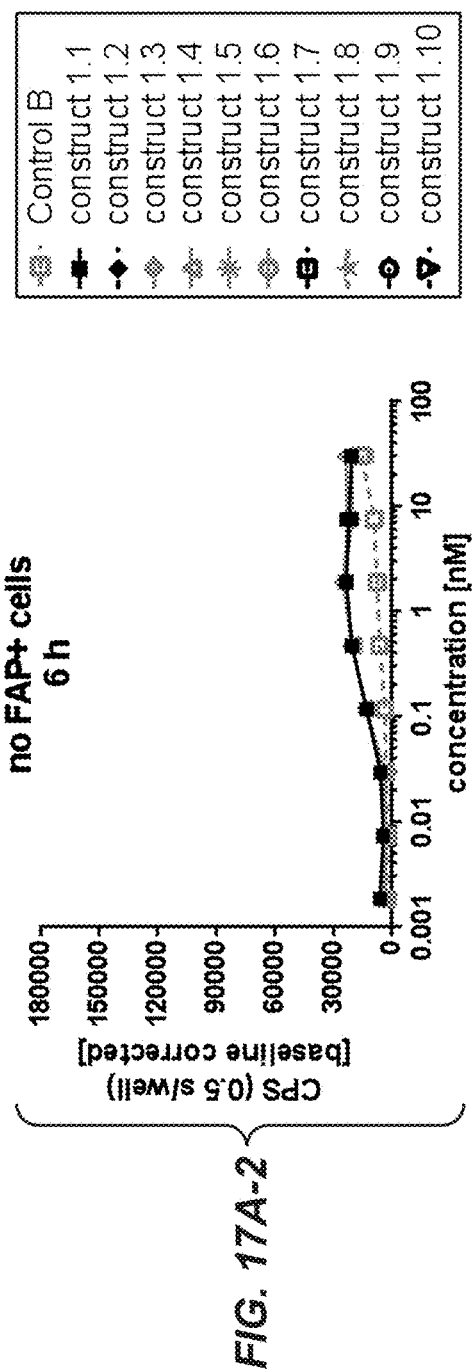
FIG. 17A-1
FIG. 17A-2

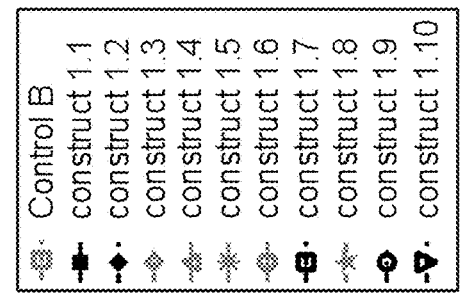
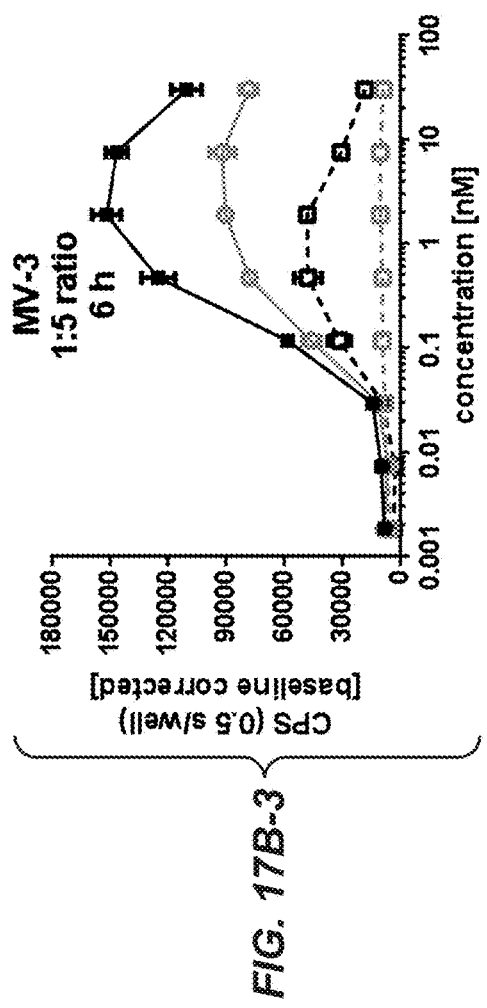
FIG. 17B-3
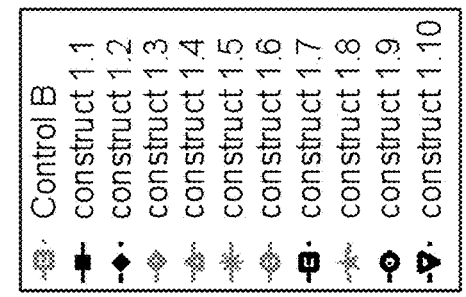
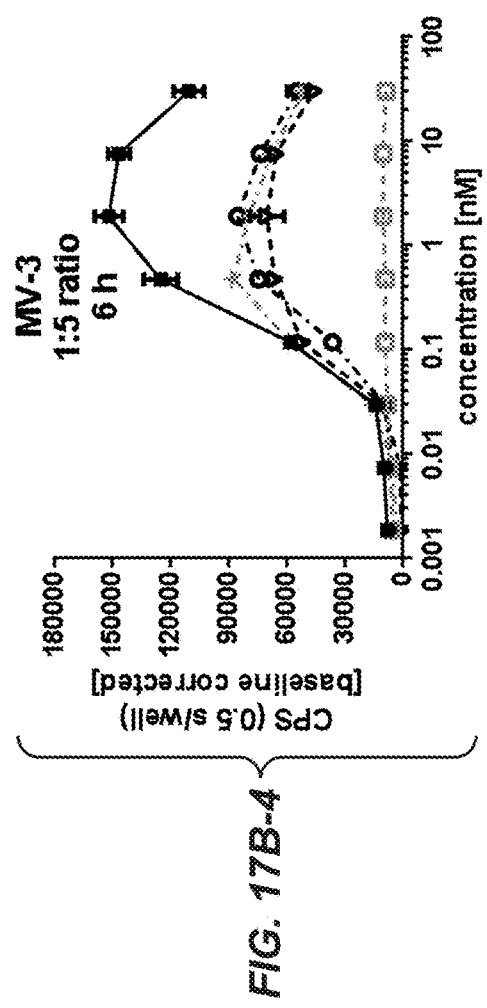
FIG. 17B-4

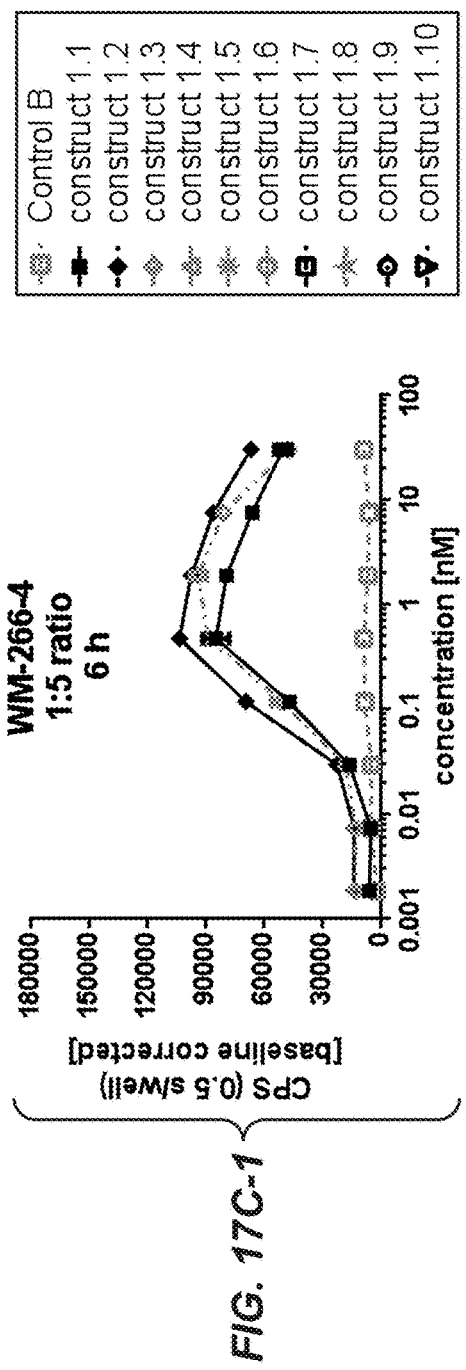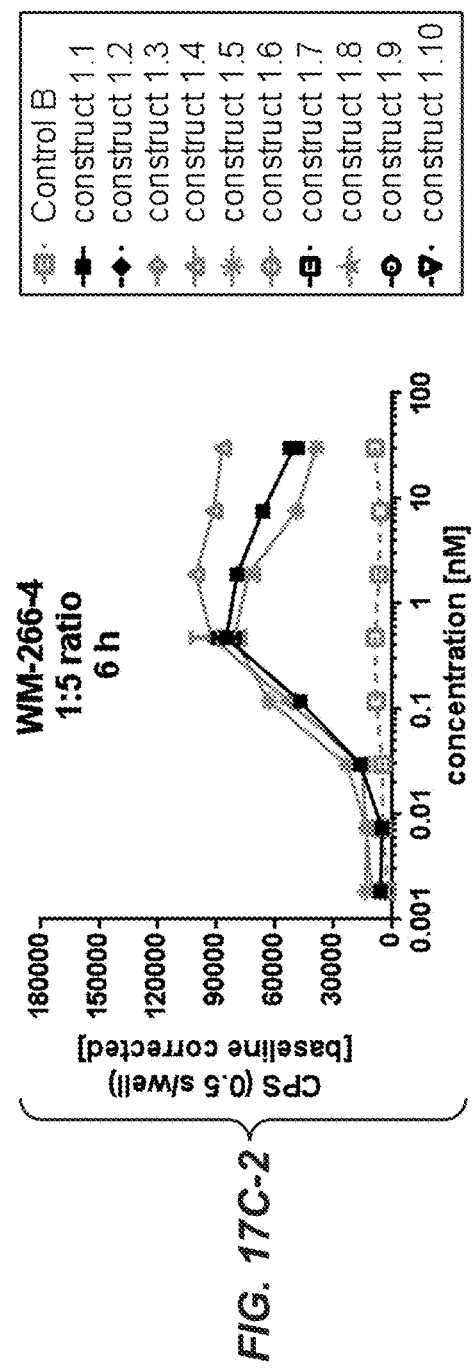
FIG. 17C-1  FIG. 17C-2

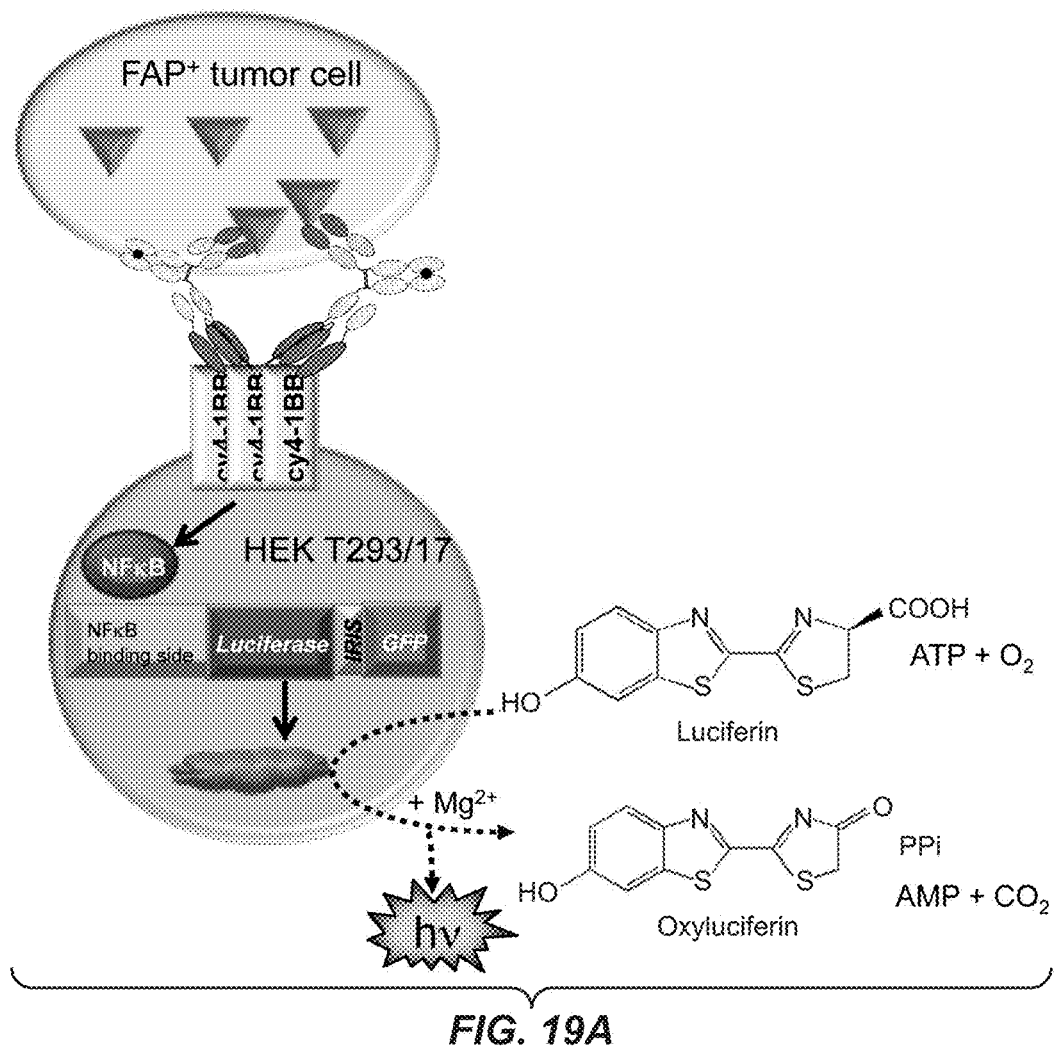
FIG. 19A
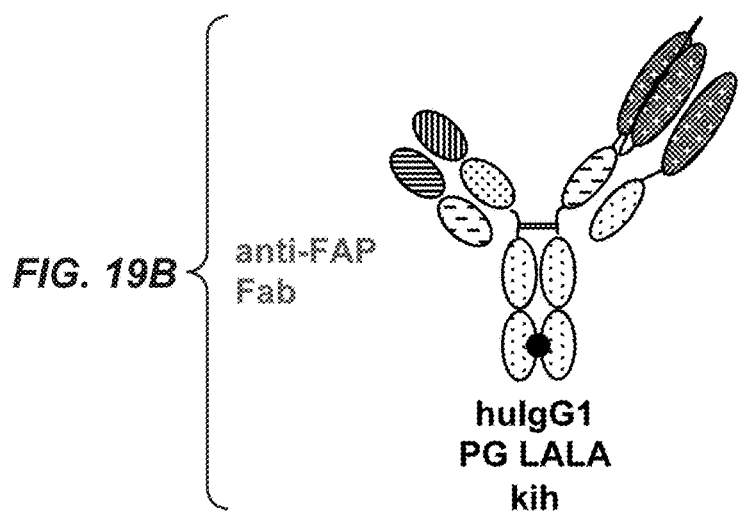
FIG. 19B anti-FAP Fab
huIgG1 PG LALA kih

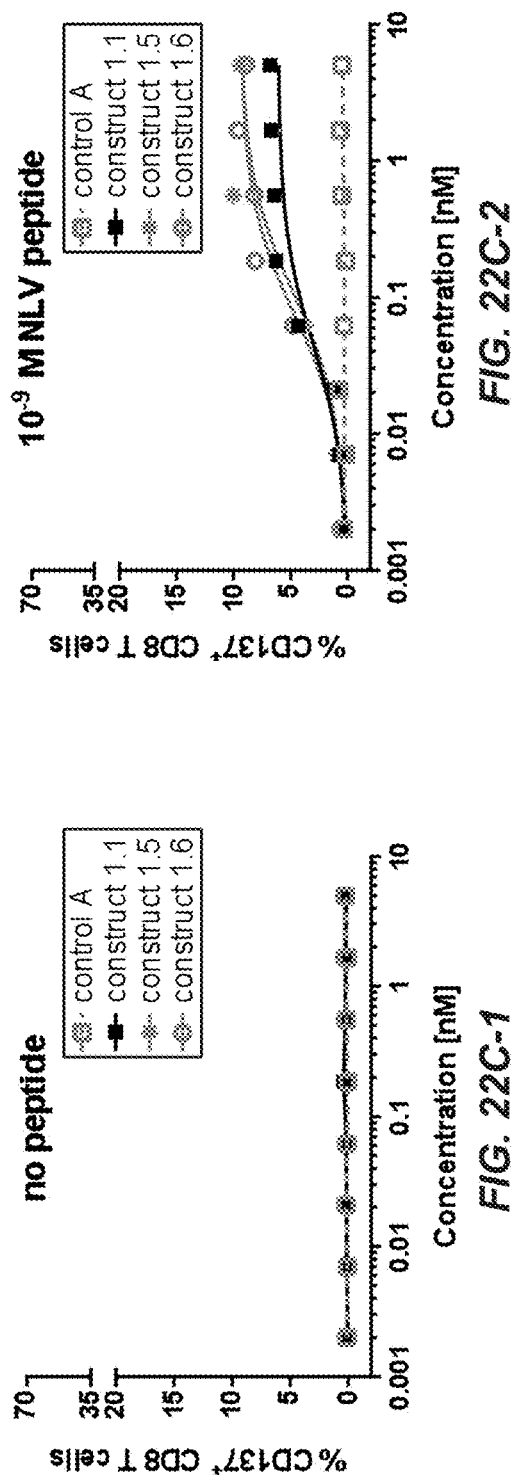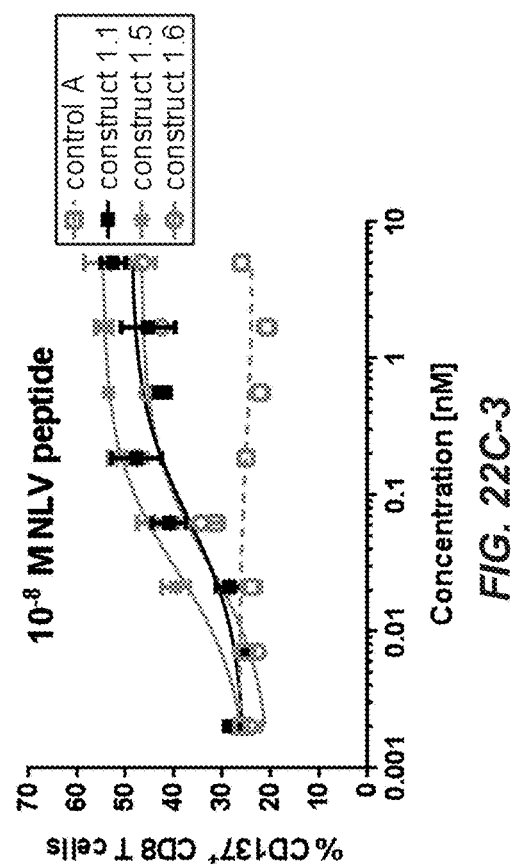
FIG. 22C-1
FIG. 22C-2
FIG. 22C-3

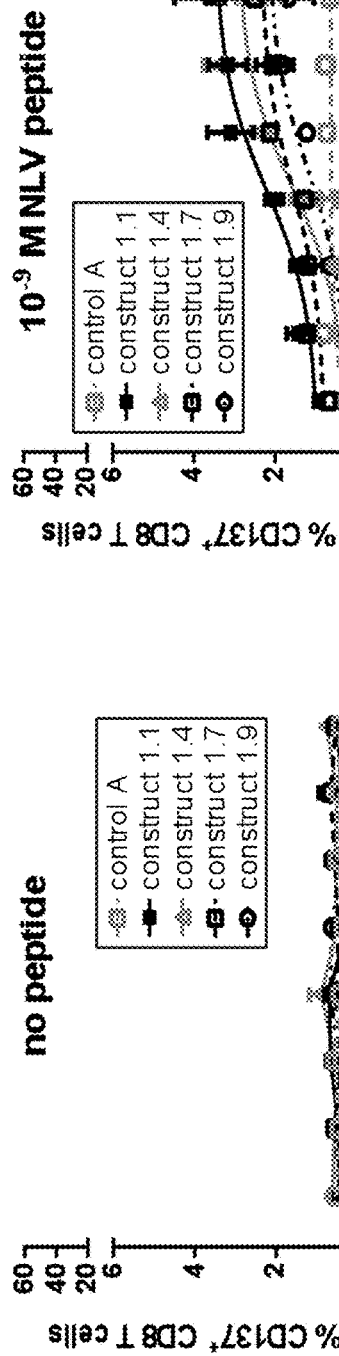
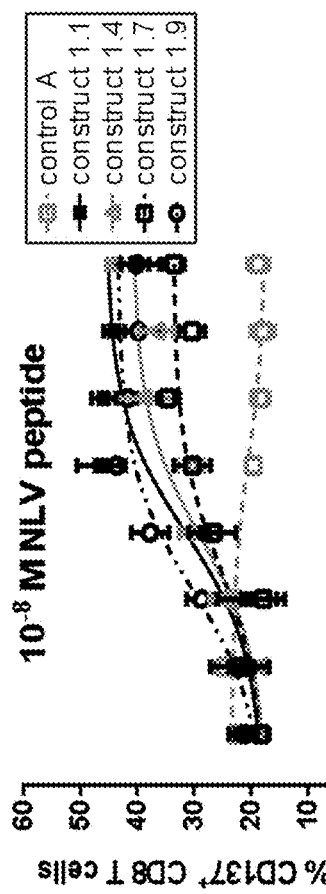
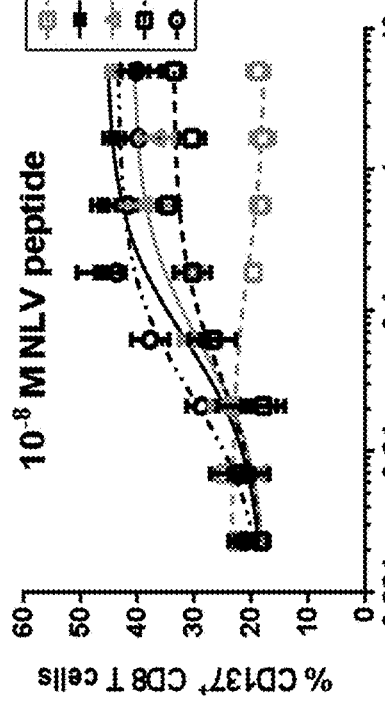
FIG. 22D-1
FIG. 22D-2
FIG. 22D-3

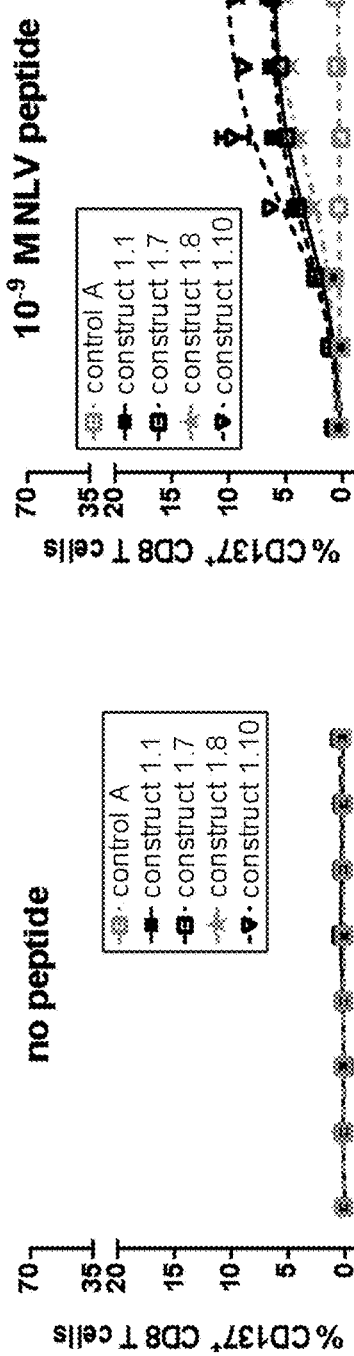
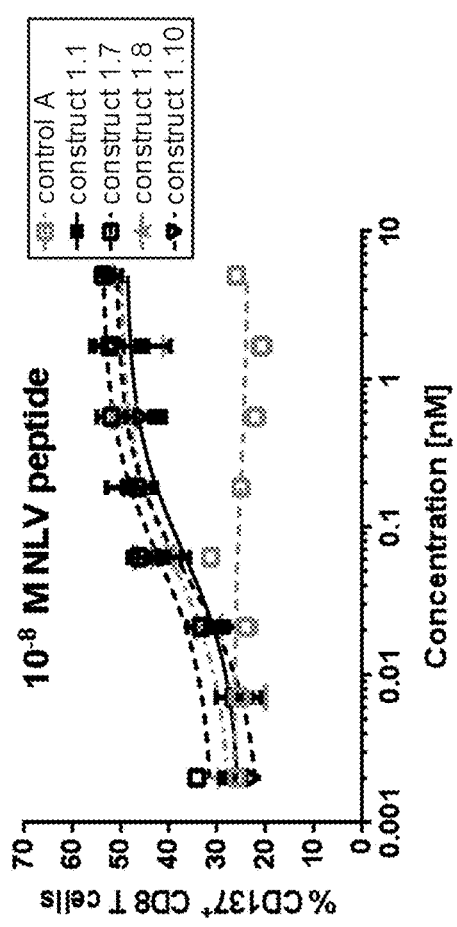
FIG. 22E-1
FIG. 22E-2
FIG. 22E-3

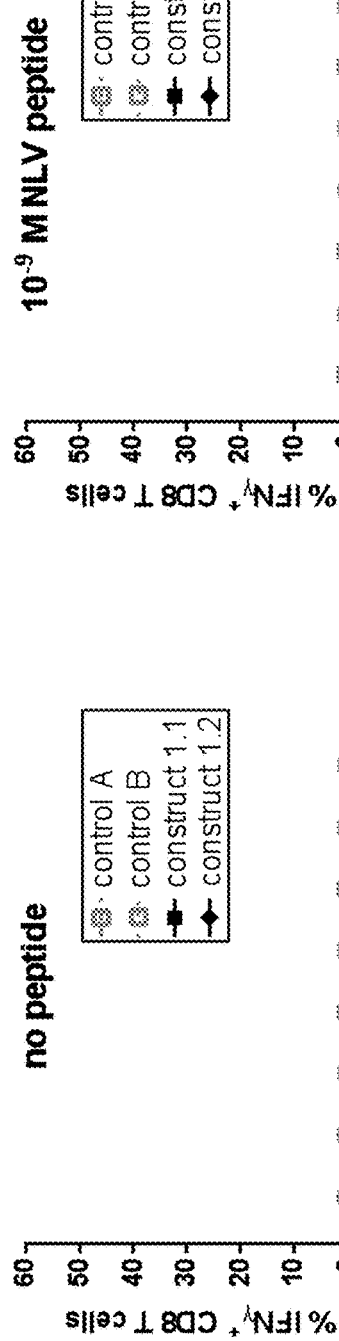
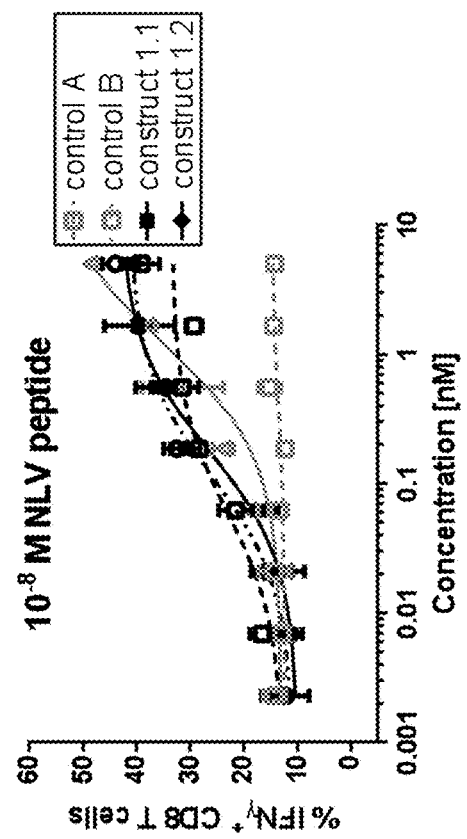
FIG. 23A-1
FIG. 23A-2
FIG. 23A-3

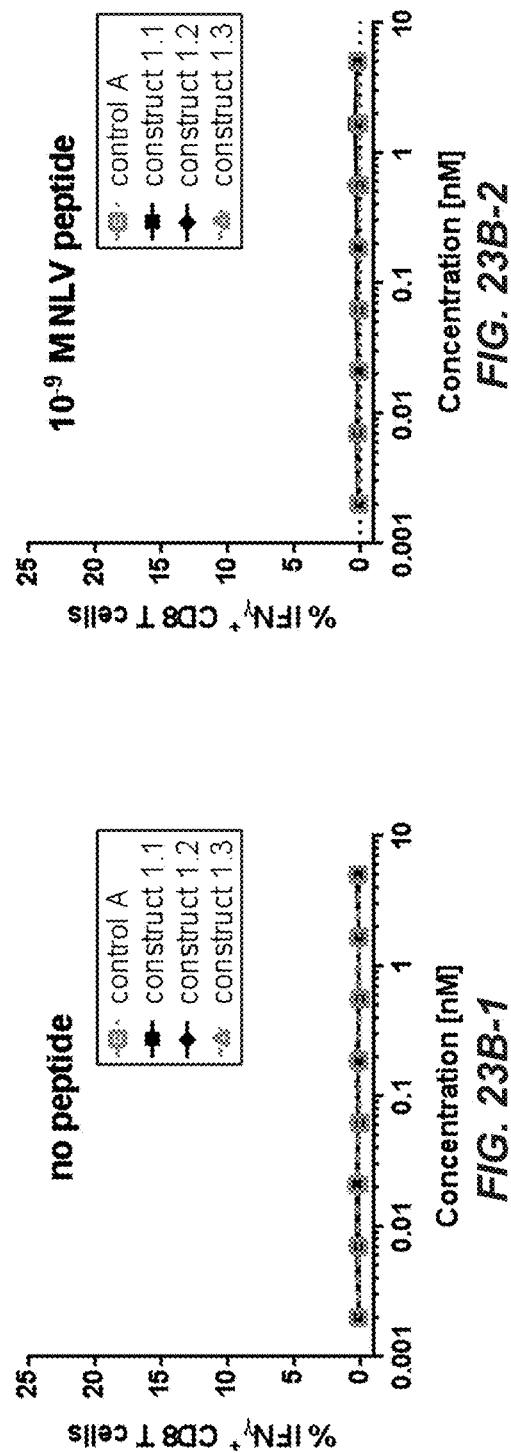

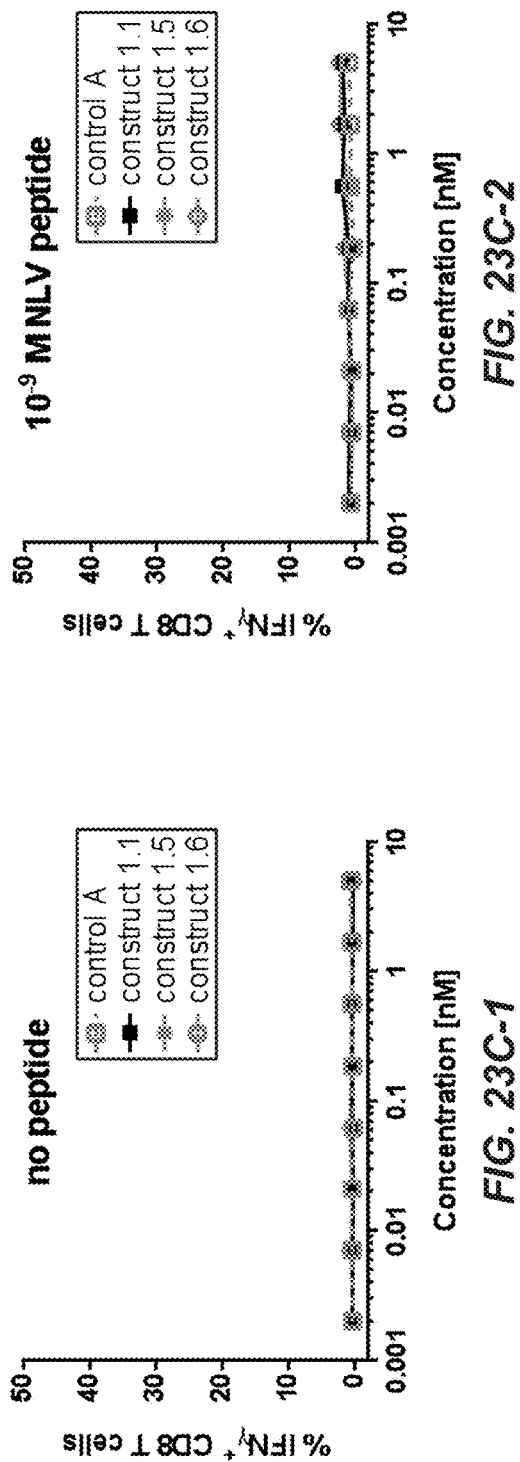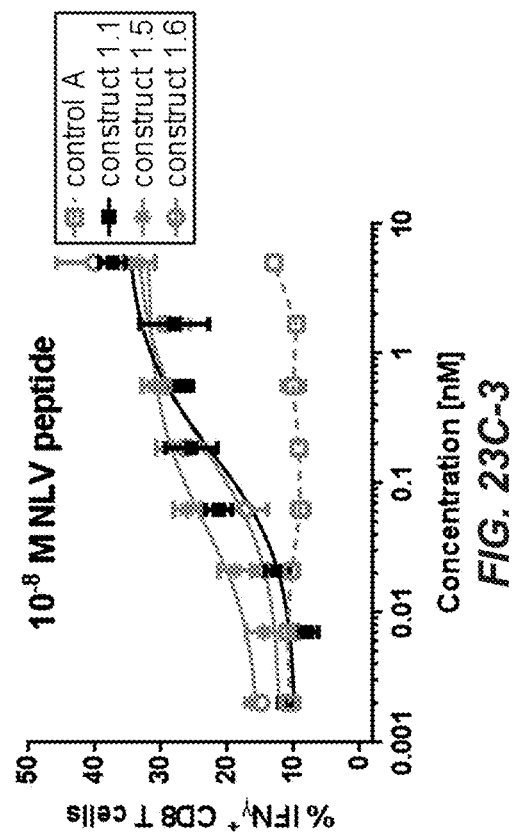
FIG. 23C-1, FIG. 23C-2, FIG. 23C-3

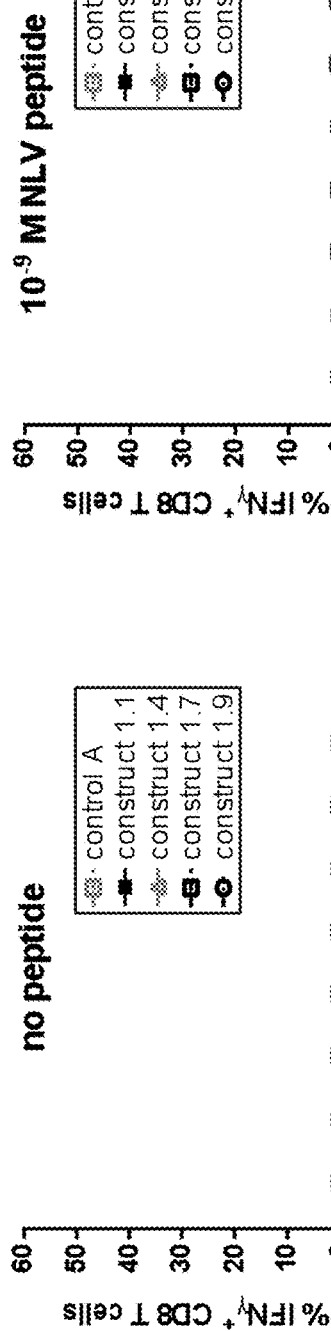
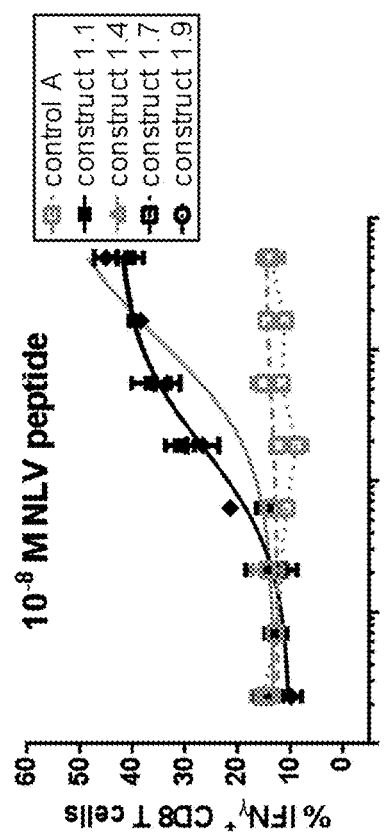
FIG. 23D-1
FIG. 23D-2
FIG. 23D-3

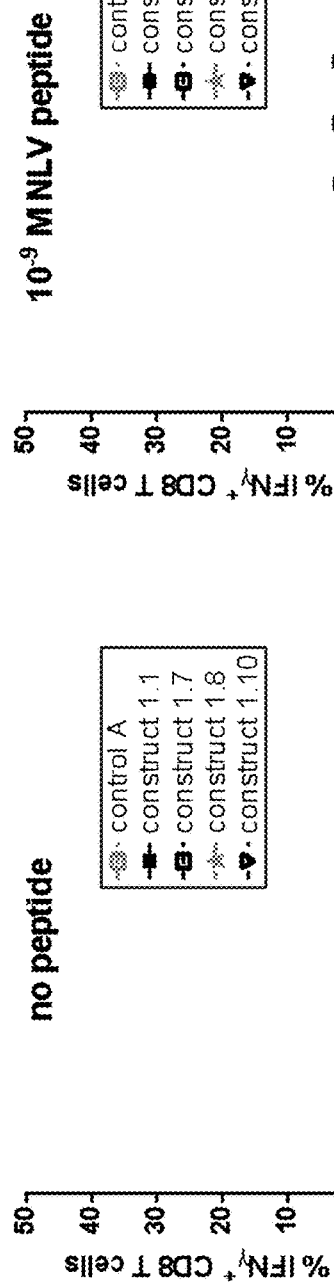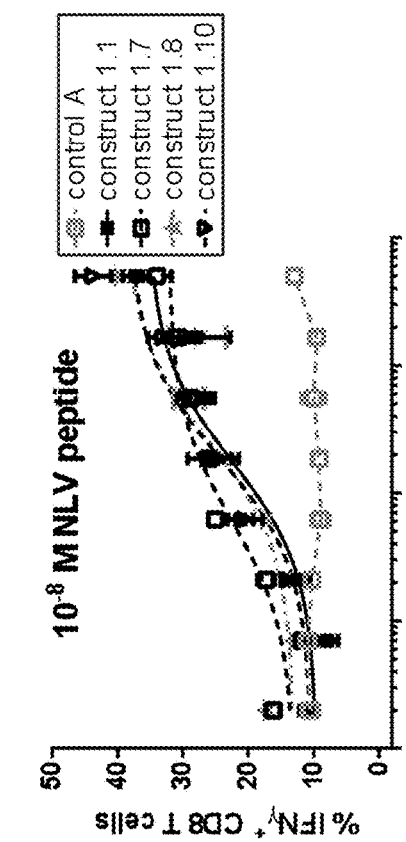
FIG. 23-1
FIG. 23E-2
FIG. 23E-3

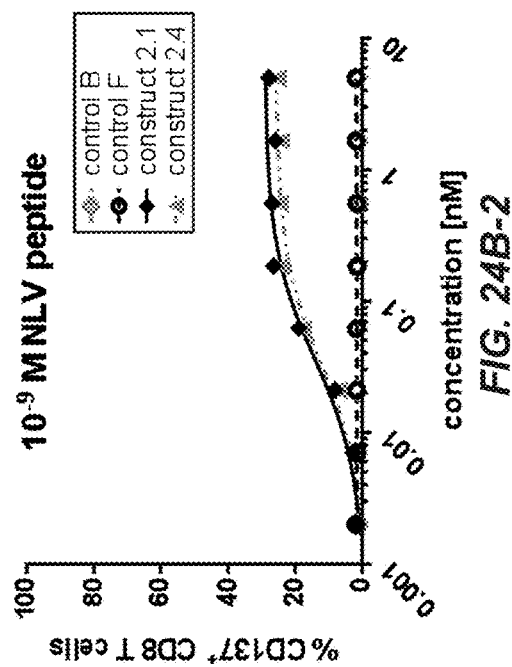
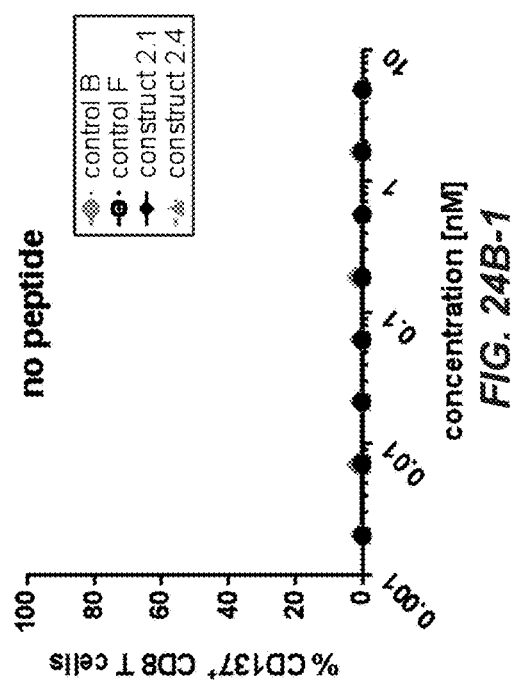
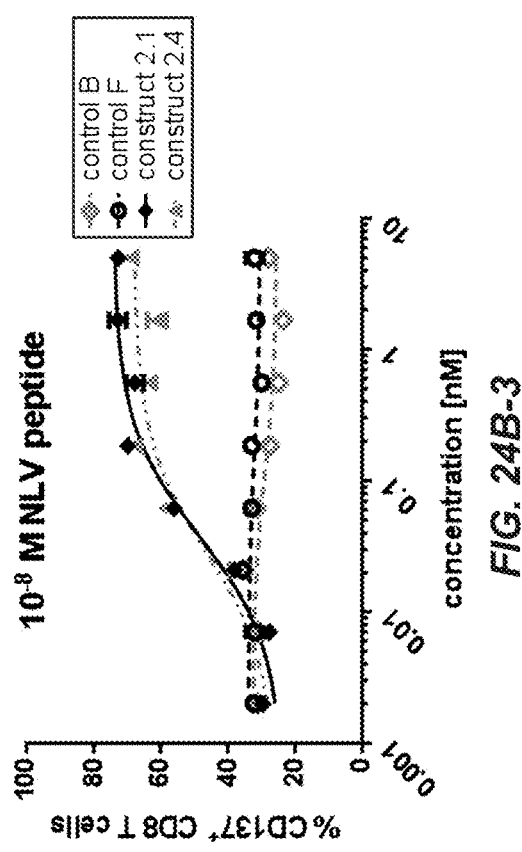
FIG. 24B-1
FIG. 24B-2
FIG. 24B-3

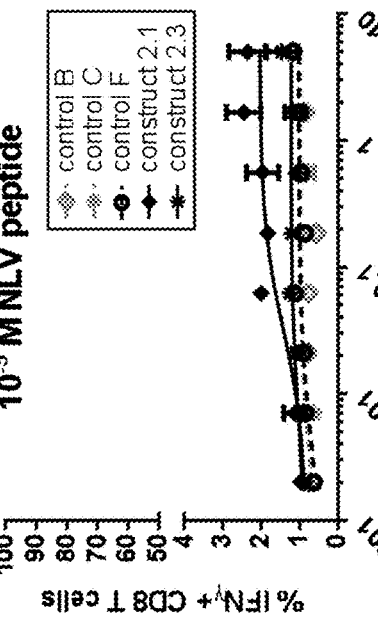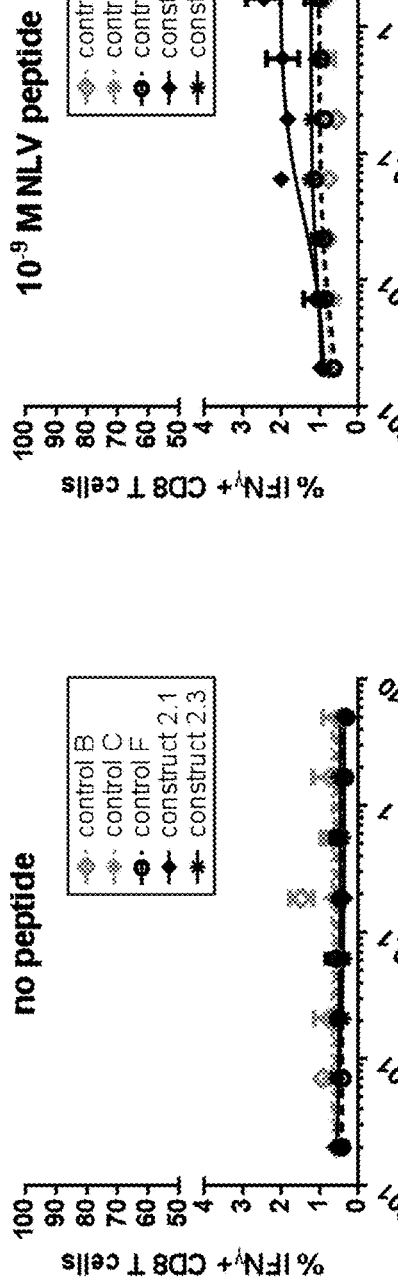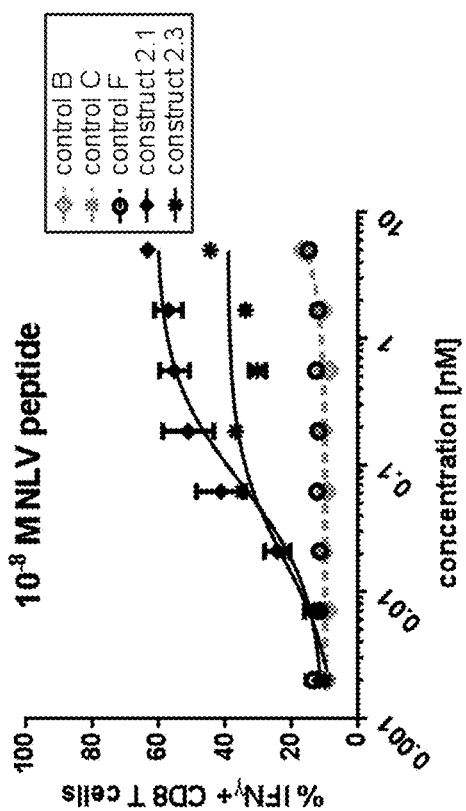
FIG. 25A-1, FIG. 25A-2, FIG. 25A-3

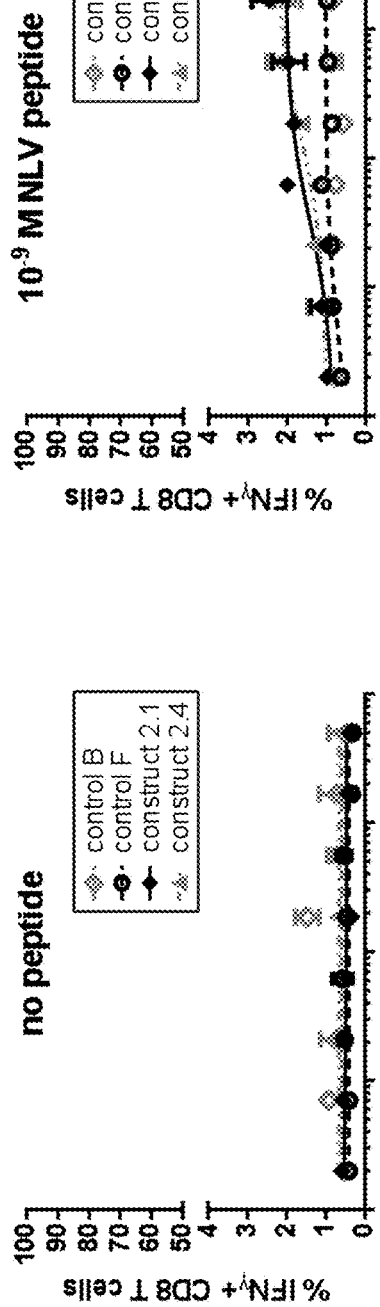
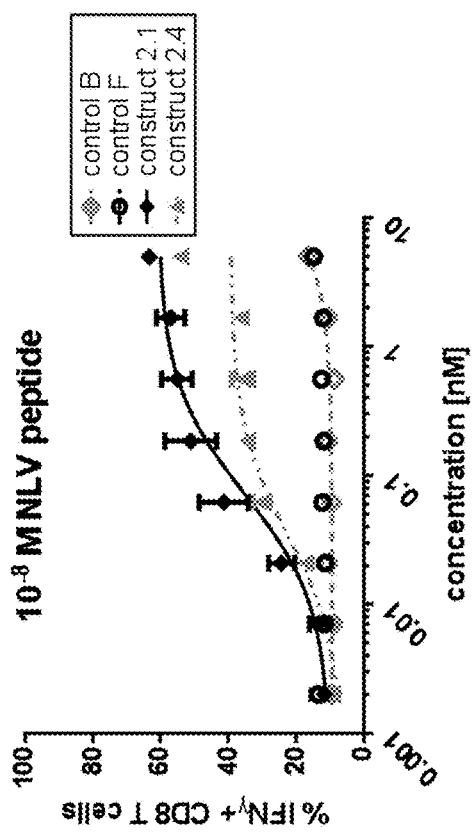
FIG. 25B-1
FIG. 25B-2
FIG. 25B-3

CDRs according to Kabat numbering

| | 20 | 21 | 22 | 23 | CDR L1 24-34 | | | | | | | | | | | | | | | | 35 | 36 | 37 | 38 | 39 | 40 | 41 | 42 | 43 | 44 | 45 | 46 | 47 | 48 | 49 | CDR L2 50-56 | | | | | | | | 57 | 58 | 59 | 60 | 61 |
|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|
| | | | | | 24 | 25 | 26 | 27 | 27a | 27b | 27c | 27d | 27e | 28 | 29 | 30 | 31 | 32 | 33 | 34 | | | | | | | | | | | | | | | | 50 | 51 | 52 | 53 | 54 | 55 | 56 | | | | | |
| | S | I | S | C | K | S | S | Q | S | L | E | N | S | N | G | N | T | Y | L | N | W | Y | L | Q | K | P | G | Q | S | P | Q | L | L | I | Y | R | V | S | K | R | F | S | G | V | P | D | R |
| | | | | | | | | | | | | | X | X | X | | X | X | | | | | | | | | | | | | | | | | X | | | X | X | X | X | | | | | |

| | 62 | 63 | 64 | 65 | 66 | 67 | 68 | 69 | 70 | 71 | 72 | 73 | 74 | 75 | 76 | 77 | 78 | 79 | 80 | 81 | 82 | 83 | 84 | 85 | 86 | 87 | 88 | CDR L3 89-97 | | | | | | | | | 98 | 99 | 100 | 101 | 102 | 103 | 104 | 105 | 106 | 107 |
|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|
| | | | | | | | | | | | | | | | | | | | | | | | | | | | | 89 | 90 | 91 | 92 | 93 | 94 | 95 | 96 | 97 | | | | | | | | | | |
| | F | S | G | S | G | S | G | T | D | F | T | L | K | I | S | R | V | E | A | E | D | V | G | V | Y | Y | C | L | Q | L | T | H | V | P | Y | T | F | G | Q | G | T | K | L | E | I | K |
| | | | | | | | | | | | | | | | | | | | | | | | | | | | | | | X | X | X | X | X | X | X | | | | | | | | | | |

8B8 VL sequence

X = randomized positions

CDRs according to Kabat numbering

CDR H1 (positions 31–35)

| 23 | 24 | 25 | 26 | 27 | 28 | 29 | 30 | 31 | 32 | 33 | 34 | 35 | 36 | 37 | 38 | 39 | 40 | 41 | 42 | 43 | 44 | 45 | 46 | 47 | 48 | 49 | 50 | 51 | 52 | 52a | 53 | 54 | 55 | 56 | 57 | 58 | 59 | 60 | 61 | 62 | 63 | 64 | 65 | 66 | 67 | 68 | 69 | 70 | 71 |
|----|----|----|----|----|----|----|----|----|----|----|----|----|----|----|----|----|----|----|----|----|----|----|----|----|----|----|----|----|----|-----|----|----|----|----|----|----|----|----|----|----|----|----|----|----|----|----|----|----|----|
| K | A | S | G | Y | T | F | T | D | Y | I | M | H | W | V | R | Q | A | P | G | Q | G | L | E | W | M | G | Y | I | N | P | Y | N | D | G | S | K | Y | T | E | K | F | Q | G | R | V | T | M | T | S |
|   |   |   |   |   | X |   |   | X | X | X | X |   |   |   |   |   |   |   |   |   |   |   |   |   |   |   | X |   | X | X | X | X |   | X | X | X |   |   |   |   |   |   |   |   |   |   |   |   |   |

CDR H2 (positions 50–65)

CDR H3 (positions 95–102)

| 72 | 73 | 74 | 75 | 76 | 77 | 78 | 79 | 80 | 81 | 82 | 82a | 82b | 82c | 83 | 84 | 85 | 86 | 87 | 88 | 89 | 90 | 91 | 92 | 93 | 94 | 95 | 96 | 97 | 98 | 99 | 100 | 100a | 100b | 100c | 100d | 101 | 102 | 103 | 104 | 105 | 106 | 107 | 108 | 109 | 110 | 111 | 112 | 113 |
|----|----|----|----|----|----|----|----|----|----|----|-----|-----|-----|----|----|----|----|----|----|----|----|----|----|----|----|----|----|----|----|----|-----|------|------|------|------|-----|-----|-----|-----|-----|-----|-----|-----|-----|-----|-----|-----|-----|
| D | T | S | I | S | T | A | Y | M | E | L | S | R | L | R | S | D | D | T | A | V | Y | Y | C | A | R | G | T | Y | Y | Y | G | S | A | L | F | D | Y | W | G | Q | G | T | T | V | T | V | S | S |
|   |   |   |   |   |   |   |   |   |   |   |     |     |     |    |    |    |    |    |    |    |    |    |    |    |    | X | X | X | X | X | X | X | X | X |   |   |   |   |   |   |   |   |   |   |   |   |   |   |

8B8 VH sequence

X = randomized positions

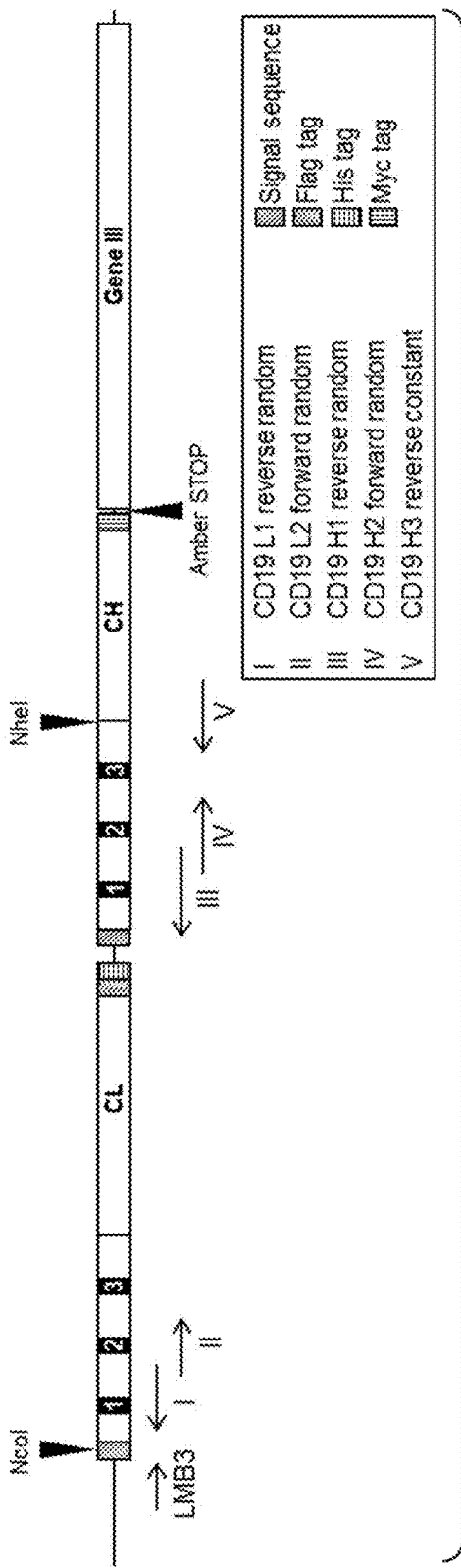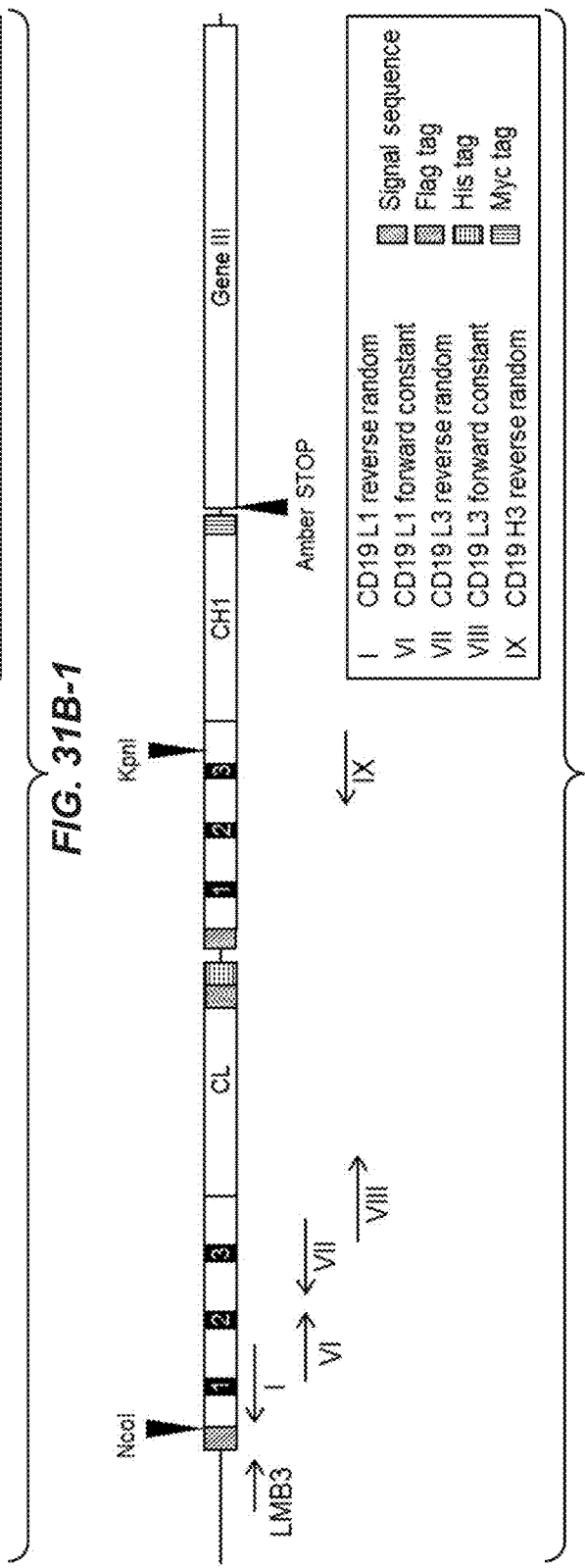
FIG. 31B-1
FIG. 31B-2

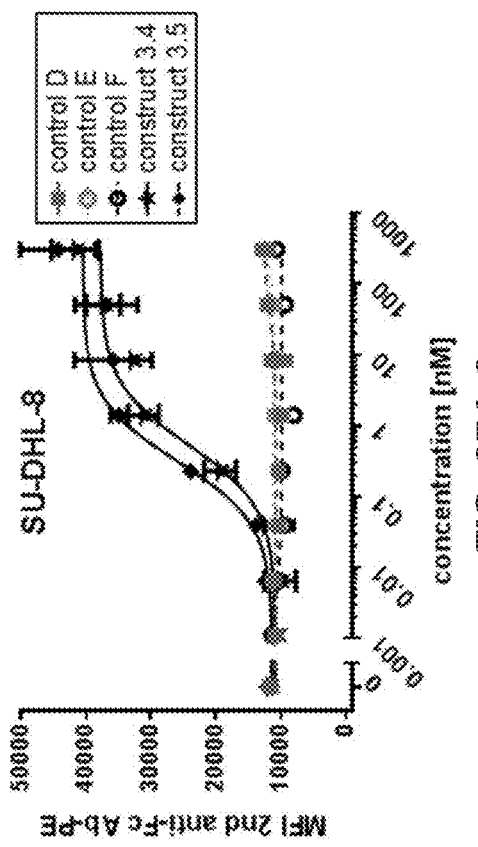
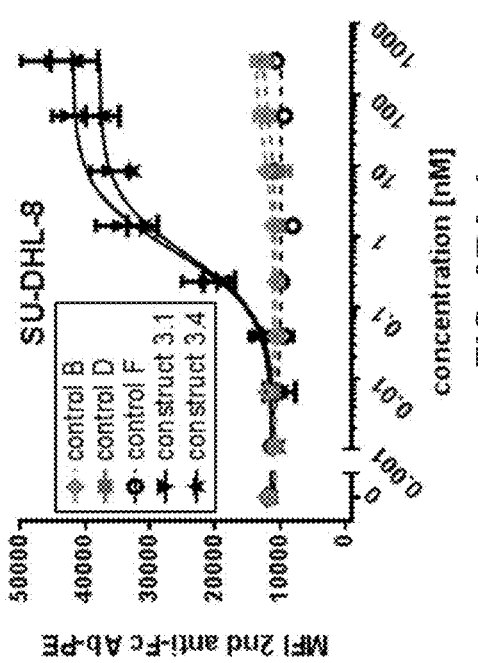
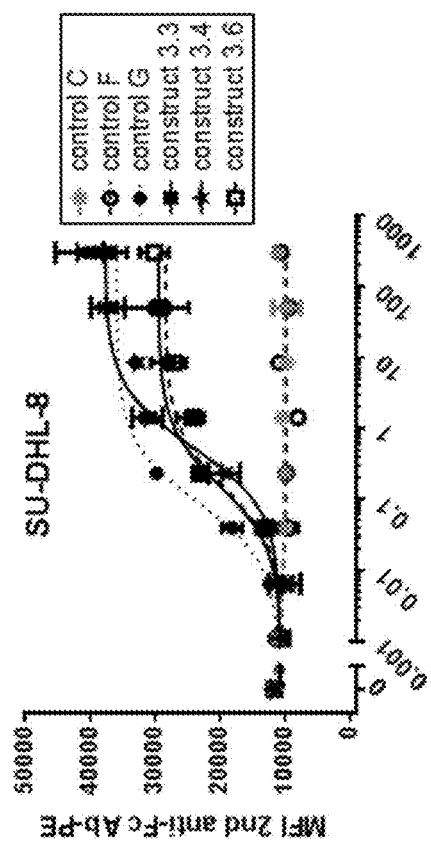
FIG. 37A-1
FIG. 37A-2
FIG. 37A-3

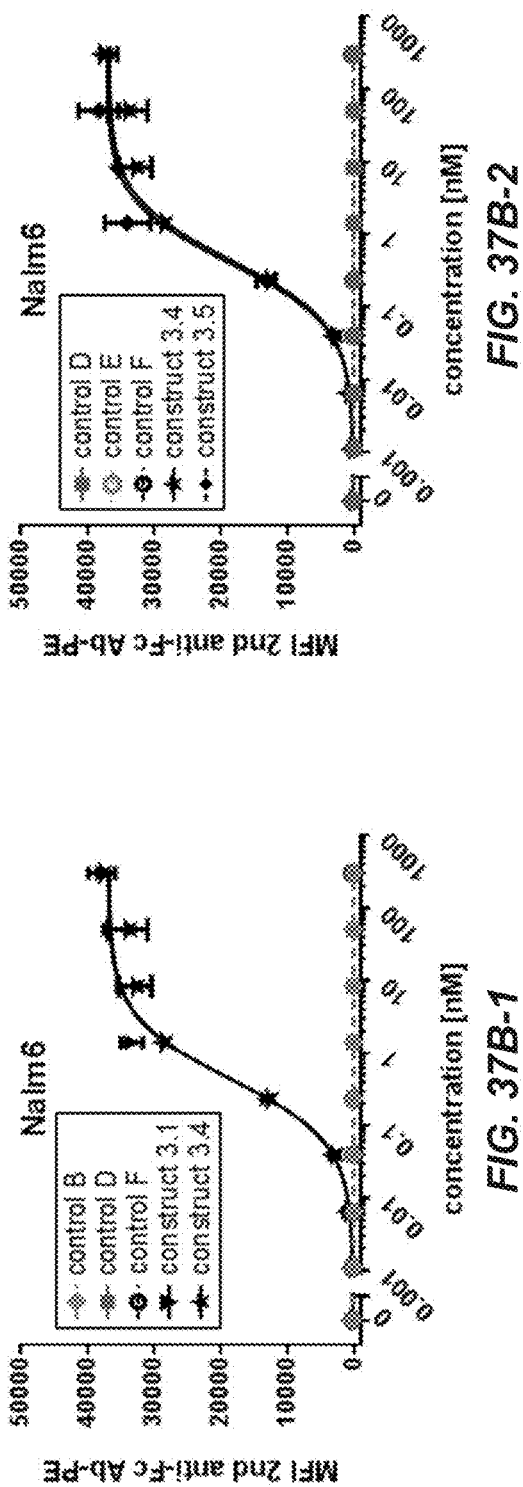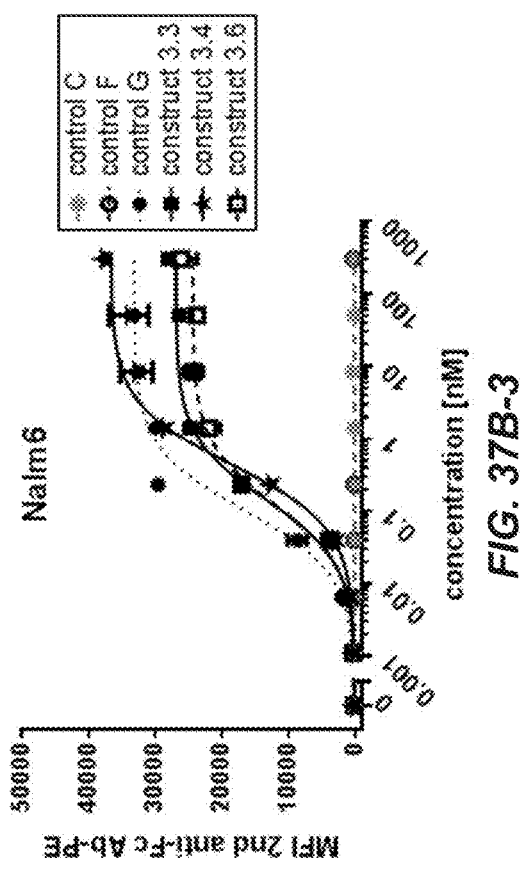

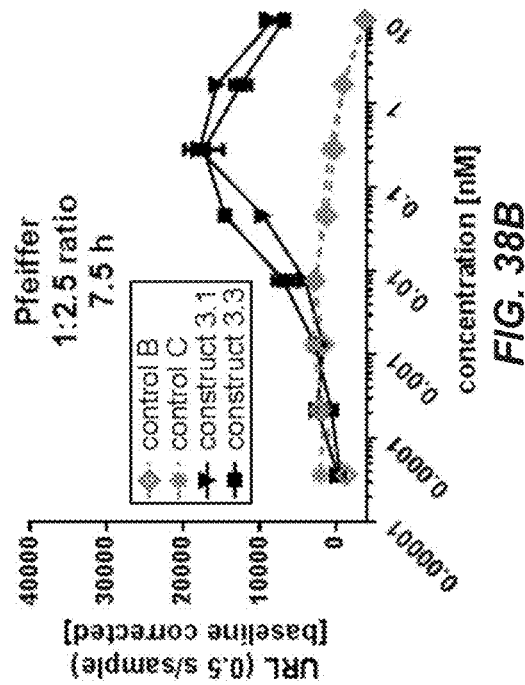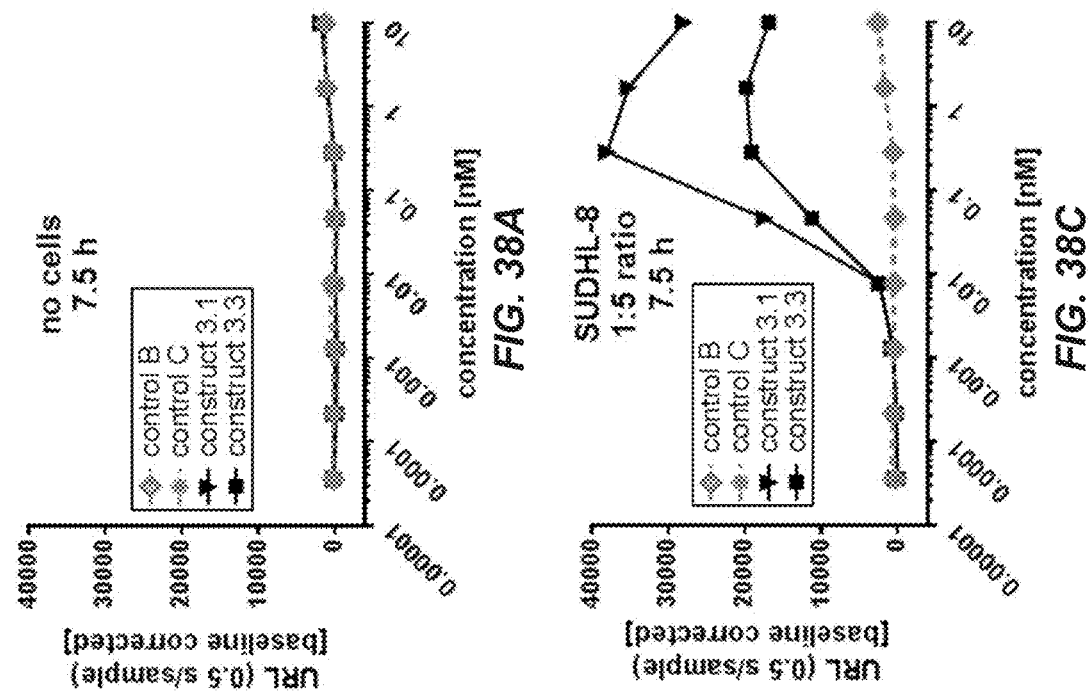
FIG. 38A FIG. 38B FIG. 38C

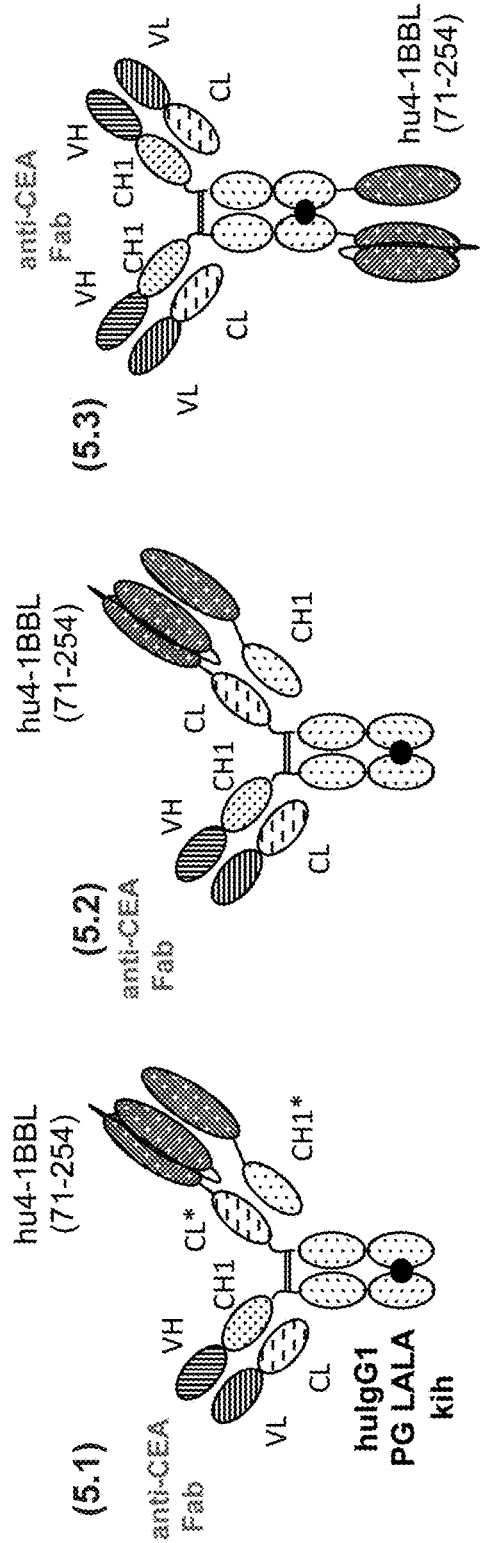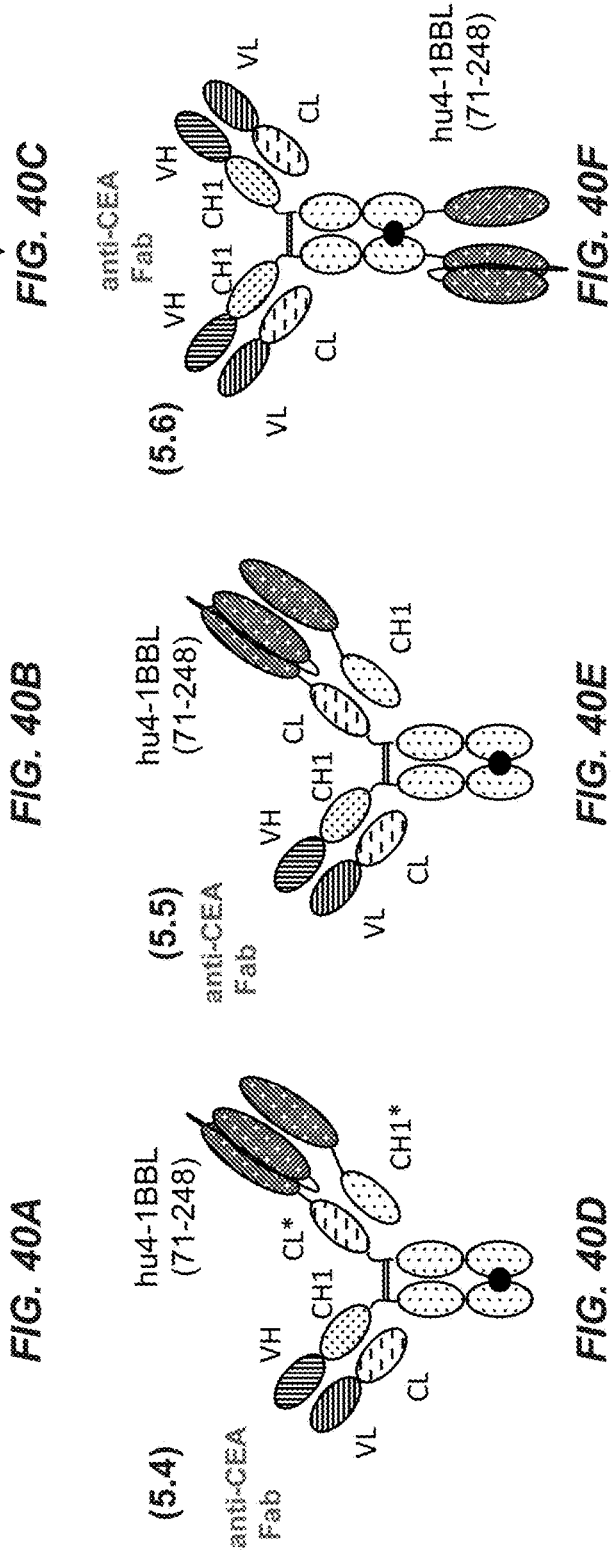

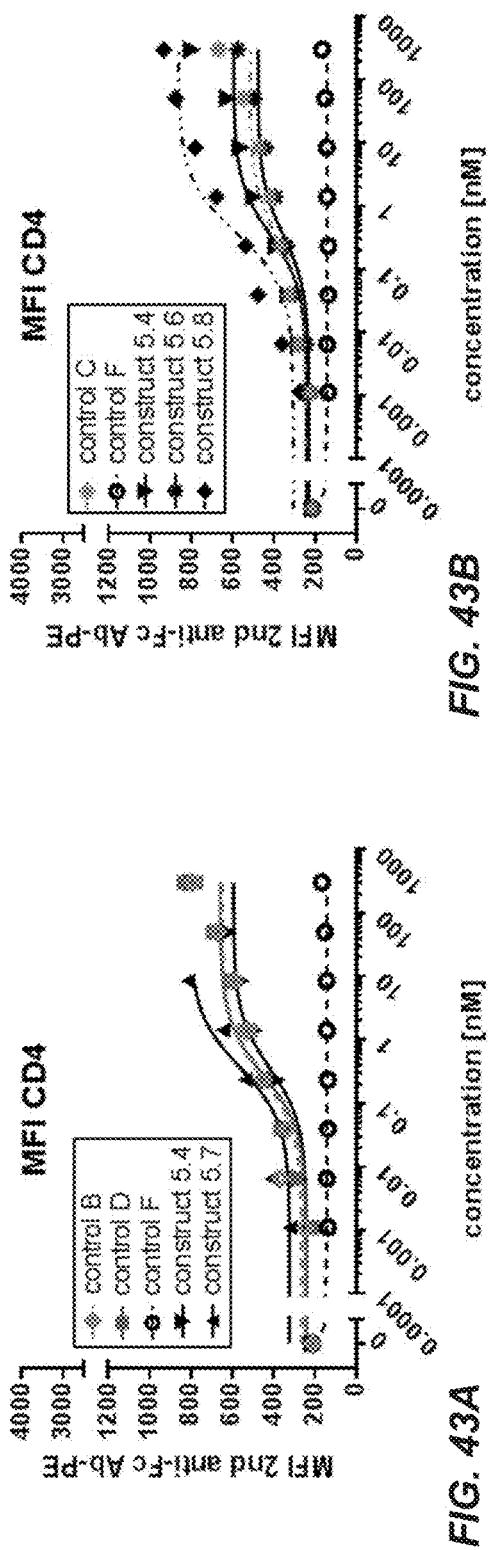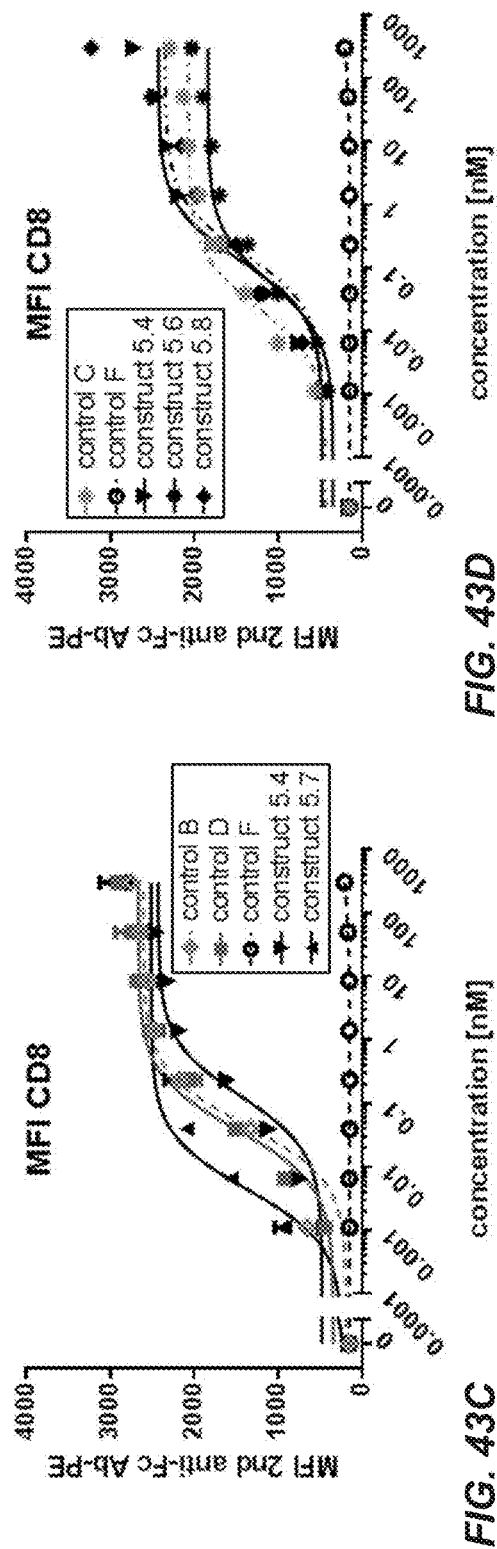
FIG. 43A
FIG. 43B
FIG. 43C
FIG. 43D

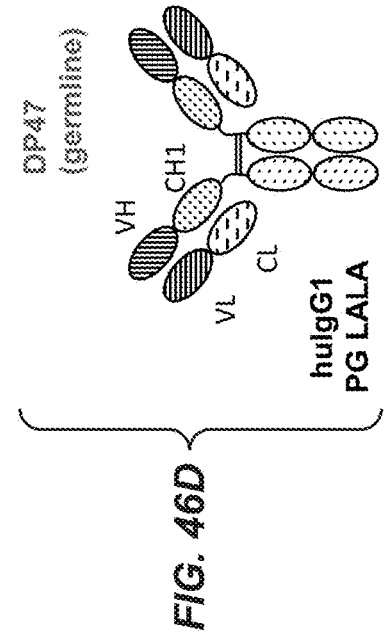
FIG. 46A
FIG. 46B
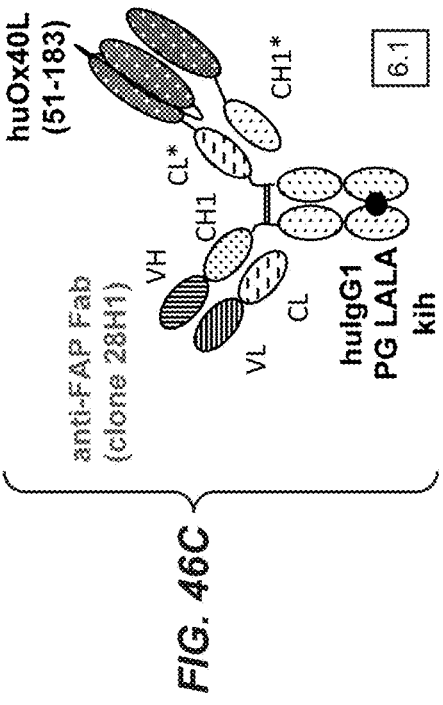
FIG. 46C
FIG. 46D

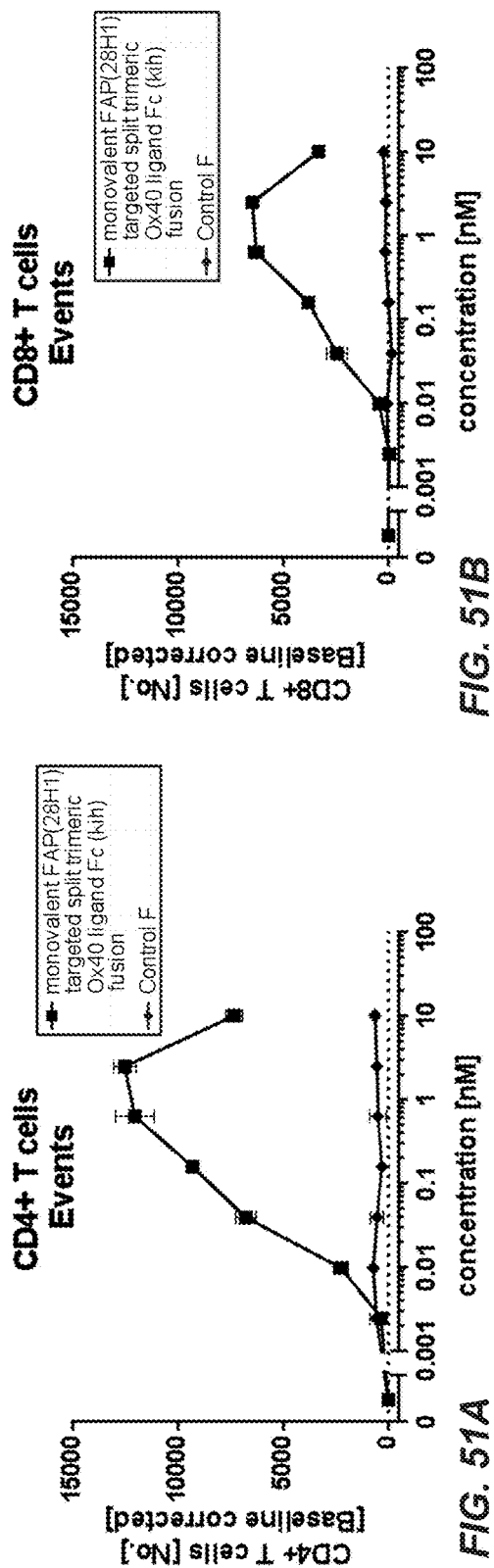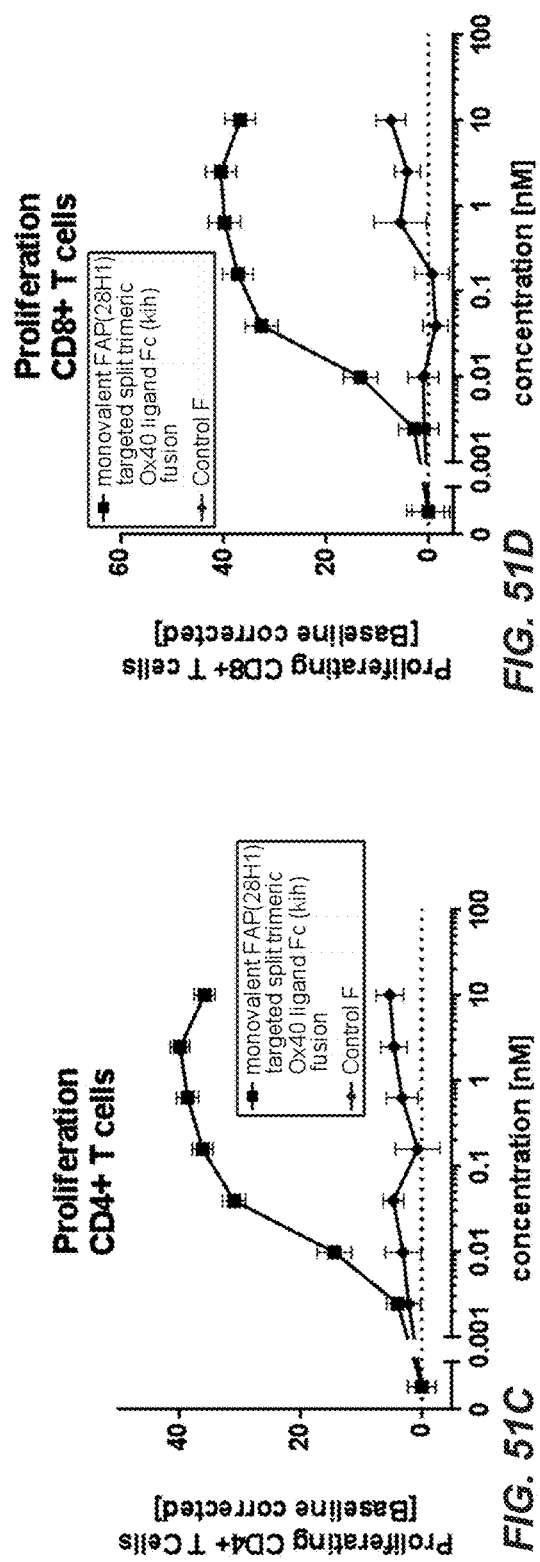
FIG. 51A
FIG. 51B
FIG. 51C
FIG. 51D

TUMOR NECROSIS FACTOR (TNF) FAMILY LIGAND TRIMER-CONTAINING ANTIGEN-BINDING MOLECULES

CROSS REFERENCE TO RELATED APPLICATIONS

This application is continuation of International Patent Application No. PCT/EP2015/076528, filed Nov. 13, 2015, which claims priority to European Patent Application No. EP 14193260.8 now withdrawn, filed Nov. 14, 2014, European Patent Application No. EP 15183736.6 now abandoned, filed Sep. 3, 2015, and to European Patent Application No. EP 15188142.2 now abandoned, filed Oct. 2, 2015, the disclosures of which are incorporated herein by reference in their entirety.

SEQUENCE LISTING

The present application contains a Sequence Listing which has been submitted in ASCII format via EFS-Web and is hereby incorporated by reference in its entirety. Said ASCII copy, created on Nov. 11, 2015, is named P32429-US_ST25.txt and is 858,073 bytes in size.

FIELD OF THE INVENTION

The invention relates to novel TNF family ligand trimer-containing antigen binding molecules comprising (a) at least one moiety capable of specific binding to a target cell antigen and (b) a first and a second polypeptide that are linked to each other by a disulfide bond, wherein the antigen binding molecules are characterized in that the first polypeptide comprises two ectodomains of a TNF ligand family member or two fragments thereof that are connected to each other by a peptide linker and in that the second polypeptide comprises only one ectodomain of said TNF ligand family member or a fragment thereof. The invention further relates to methods of producing these molecules and to methods of using the same.

BACKGROUND

Ligands interacting with molecules of the TNF (tumor necrosis factor) receptor superfamily have pivotal roles in the organization and function of the immune system. While regulating normal functions such as immune responses, hematopoiesis and morphogenesis, the TNF family ligands (also called cytokines) play a role in tumorgenesis, transplant rejection, septic shock, viral replication, bone resorption, rheumatoid arthritis and diabetes (Aggarwal, 2003). The TNF ligand family comprises 18 genes encoding 19 type II (i.e. intracellular N terminus and extracellular C-terminus) transmembrane proteins, characterized by the presence of a conserved C-terminal domain coined the 'TNF homology domain' (THD). This domain is responsible for receptor binding and is thus critical for the biological activity of the TNF ligand family members. The sequence identity between family members is ~20-30% (Bodmer, 2002). Members of the TNF ligand family exert their biological function as self-assembling, noncovalent trimers (Banner et al, Cell 1993, 73, 431-445). Thus, the TNF family ligands form a trimer that is able to bind to and to activate the corresponding receptors of TNFR superfamily.

4-1BB (CD137), a member of the TNF receptor superfamily, has been first identified as a molecule whose expression is induced by T-cell activation (Kwon and Weissman, 1989). Subsequent studies demonstrated expression of 4-1BB in T- and B-lymphocytes (Snell et al., 2011; Zhang et al., 2010), NK-cells (Lin et al., 2008), NKT-cells (Kim et al., 2008), monocytes (Kienzle and von Kempis, 2000; Schwarz et al., 1995), neutrophils (Heinisch et al., 2000), mast (Nishimoto et al., 2005) and dendritic cells as well as cells of non-hematopoietic origin such as endothelial and smooth muscle cells (Broll et al., 2001; Olofsson et al., 2008). Expression of 4-1BB in different cell types is mostly inducible and driven by various stimulatory signals, such as T-cell receptor (TCR) or B-cell receptor triggering, as well as signaling induced through co-stimulatory molecules or receptors of pro-inflammatory cytokines (Diehl et al., 2002; von Kempis et al., 1997; Zhang et al., 2010).

Expression of 4-1BB ligand (4-1BBL or CD137L) is more restricted and is observed on professional antigen presenting cells (APC) such as B-cells, dendritic cells (DCs) and macrophages. Inducible expression of 4-1BBL is characteristic for T-cells, including both αβ and γδ T-cell subsets, and endothelial cells (reviewed in Shao and Schwarz, 2011).

CD137 signaling is known to stimulate IFNγ secretion and proliferation of NK cells (Buechele et al., 2012; Lin et al., 2008; Melero et al., 1998) as well as to promote DC activation as indicated by their increased survival and capacity to secret cytokines and upregulate co-stimulatory molecules (Choi et al., 2009; Futagawa et al., 2002; Wilcox et al., 2002). However, CD137 is best characterized as a co-stimulatory molecule which modulates TCR-induced activation in both the CD4+ and CD8+ subsets of T-cells. In combination with TCR triggering, agonistic 4-1BB-specific antibodies enhance proliferation of T-cells, stimulate lymphokine secretion and decrease sensitivity of T-lymphocytes to activation-induced cells death (reviewed in (reviewed in Snell et al., 2011).

In line with these co-stimulatory effects of 4-1BB antibodies on T-cells in vitro, their administration to tumor bearing mice leads to potent anti-tumor effects in many experimental tumor models (Melero et al., 1997; Narazaki et al., 2010). However, 4-1BB usually exhibits its potency as an anti-tumor agent only when administered in combination with other immunomodulatory compounds (Curran et al., 2011; Guo et al., 2013; Morales-Kastresana et al., 2013; Teng et al., 2009; Wei et al., 2013), chemotherapeutic reagents (Ju et al., 2008; Kim et al., 2009), tumor-specific vaccination (Cuadros et al., 2005; Lee et al., 2011) or radiotherapy (Shi and Siemann, 2006). In vivo depletion experiments demonstrated that CD8+ T-cells play the most critical role in anti-tumoral effect of 4-1BB-specific antibodies. However, depending on the tumor model or combination therapy, which includes anti-4-1BB, contributions of other types of cells such as DCs, NK-cells or CD4+ T-cells have been reported (Melero et al., 1997; Murillo et al., 2009; Narazaki et al., 2010; Stagg et al., 2011).

In addition to their direct effects on different lymphocyte subsets, 4-1BB agonists can also induce infiltration and retention of activated T-cells in the tumor through 4-1BB-mediated upregulation of intercellular adhesion molecule 1 (ICAM1) and vascular cell adhesion molecule 1 (VCAM1) on tumor vascular endothelium (Palazon et al., 2011).

4-1BB triggering may also reverse the state of T-cell anergy induced by exposure to soluble antigen that may contribute to disruption of immunological tolerance in the tumor micro-environment or during chronic infections (Wilcox et al., 2004).

It appears that the immunomodulatory properties of 4-1BB agonistic antibodies in vivo require the presence of the wild type Fc-portion on the antibody molecule thereby implicating Fc-receptor binding as an important event required for the pharmacological activity of such reagents as has been described for agonistic antibodies specific to other apoptosis-inducing or immunomodulatory members of the TNFR-superfamily (Li and Ravetch, 2011; Teng et al., 2009). However, systemic administration of 4-1BB-specific agonistic antibodies with the functionally active Fc domain also induces expansion of CD8+ T-cells associated with liver toxicity (Dubrot et al., 2010) that is diminished or significantly ameliorated in the absence of functional Fc-receptors in mice. In human clinical trials (ClinicalTrials.gov, NCT00309023), Fc-competent 4-1BB agonistic antibodies (BMS-663513) administered once every three weeks for 12 weeks induced stabilization of the disease in patients with melanoma, ovarian or renal cell carcinoma. However, the same antibody given in another trial (NCT00612664) caused grade 4 hepatitis leading to termination of the trial (Simeone and Ascierto, 2012).

Collectively, the available pre-clinical and clinical data clearly demonstrate that there is a high clinical need for effective 4-1BB agonists. However, new generation drug candidates should not only effectively engage 4-1BB on the surface of hematopoietic and endothelial cells but also be capable of achieving that through mechanisms other than binding to Fc-receptors in order to avoid uncontrollable side effects. The latter may be accomplished through preferential binding to and oligomerization on tumor-specific or tumor-associated moieties.

Fusion proteins composed of one extracellular domain of a 4-1BB ligand and a single chain antibody fragment (Mueller et al., 2008; Hornig et al., 2012) or a single 4-1BB ligand fused to the C-terminus of a heavy chain (Zhang et al, 2007) have been made. WO 2010/010051 discloses the generation of fusion proteins that consist of three TNF ligand ectodomains linked to each other and fused to an antibody part.

However, there is still a need of new antigen binding molecules that combine a moiety capable of preferred binding to tumor-specific or tumor-associated targets with a moiety capable of forming a costimulatory TNF ligand trimer and that have sufficient stability to be pharmaceutically useful. The antigen binding molecules of the present invention comprise both and surprisingly they provide a trimeric and thus biologically active TNF ligand, although one of the trimerizing TNF ligand ectodomains is located on another polypeptide than the other two TNF ligand ectodomains of the molecule.

SUMMARY OF THE INVENTION

In one aspect, the invention provides a TNF family ligand trimer-containing antigen binding molecule comprising
(a) at least one moiety capable of specific binding to a target cell antigen and
(b) a first and a second polypeptide that are linked to each other by a disulfide bond,
wherein the antigen binding molecule is characterized in that the first polypeptide comprises two ectodomains of a TNF ligand family member or two fragments thereof that are connected to each other by a peptide linker and in that the second polypeptide comprises only one ectodomain of said TNF ligand family member or a fragment thereof.

In a particular aspect, the invention provides a TNF family ligand trimer-containing antigen binding molecule comprising
(a) at least one moiety capable of specific binding to a target cell antigen, (b) a first and a second polypeptide that are linked to each other by a disulfide bond,
wherein the antigen binding molecule is characterized in that the first polypeptide comprises two ectodomains of a TNF ligand family member or two fragments thereof that are connected to each other by a peptide linker and in that the second polypeptide comprises only one ectodomain of said TNF ligand family member or a fragment thereof, and
(c) an Fc domain composed of a first and a second subunit capable of stable association.

In a further aspect, the invention provides a TNF family ligand trimer-containing antigen binding molecule, comprising
(a) at least one moiety capable of specific binding to a target cell antigen and
(b) a first and a second polypeptide that are linked to each other by a disulfide bond,
wherein the antigen binding molecule is characterized in that
(i) the first polypeptide contains a CH1 or CL domain and the second polypeptide contains a CL or CH1 domain, respectively, wherein the second polypeptide is linked to the first polypeptide by a disulfide bond between the CH1 and CL domain, and wherein the first polypeptide comprises two ectodomains of a TNF ligand family member or fragments thereof that are connected to each other and to the CH1 or CL domain by a peptide linker and wherein the second polypeptide comprises one ectodomain of said TNF ligand family member or a fragment thereof connected via a peptide linker to the CL or CH1 domain of said polypeptide, or
(ii) the first polypeptide contains a CH3 domain and the second polypeptide contains a CH3 domain, respectively, and wherein the first polypeptide comprises two ectodomains of a TNF ligand family member or fragments thereof that are connected to each other and to the C-terminus of the CH3 domain by a peptide linker and wherein the second polypeptide comprises only one ectodomain of said TNF ligand family member or a fragment thereof connected via a peptide linker to C-terminus of the CH3 domain of said polypeptide, or
(iii) the first polypeptide contains a VH-CL or a VL-CH1 domain and the second polypeptide contains a VL-CH1 domain or a VH-CL domain, respectively, wherein the second polypeptide is linked to the first polypeptide by a disulfide bond between the CH1 and CL domain, and wherein the first polypeptide comprises two ectodomains of a TNF ligand family member or fragments thereof that are connected to each other and to to VH or VL by a peptide linker and wherein the second polypeptide comprises one ectodomain of said TNF ligand family member or a fragment thereof connected via a peptide linker to VL or VH of said polypeptide.

In a particular aspect, the TNF ligand family member is one that costimulates human T-cell activation. Thus, the TNF family ligand trimer-containing antigen binding molecule comprises (a) at least one moiety capable of specific binding to a target cell antigen and
(b) a first and a second polypeptide that are linked to each other by a disulfide bond,
wherein the antigen binding molecule is characterized in that the first polypeptide comprises two ectodomains of a TNF ligand family member or two fragments thereof that are connected to each other by a peptide linker and in that the second polypeptide comprises only one ectodomain of said TNF ligand family member or a fragment thereof, wherein the TNF ligand family member costimulates human T-cell activation. More particularly, the TNF ligand family member is selected from 4-1BBL and OX40L.

In one aspect, the TNF ligand family member is 4-1BBL.

In a further aspect, the ectodomain of a TNF ligand family member comprises the amino acid sequence selected from the group consisting of SEQ ID NO:1, SEQ ID NO: 2, SEQ ID NO:3, SEQ ID NO:4, SEQ ID NO:96, SEQ ID NO: 373, SEQ ID NO:374 and SEQ ID NO:375, particularly the amino acid sequence of SEQ ID NO:1 or SEQ ID NO:96.

In another aspect, the ectodomain of a TNF ligand family member or fragment thereof comprises the amino acid sequence selected from the group consisting of SEQ ID NO:1, SEQ ID NO:2, SEQ ID NO:3, SEQ ID NO:4 and SEQ ID NO:96, particularly the amino acid sequence of SEQ ID NO:1 or SEQ ID NO:96. More particularly, the ectodomain of a TNF ligand family member comprises the amino acid sequence of SEQ ID NO:96.

In a further aspect, the TNF family ligand trimer-containing antigen binding molecule of the invention comprises
(a) at least one moiety capable of specific binding to a target cell antigen and
(b) a first and a second polypeptide that are linked to each other by a disulfide bond,
wherein the antigen binding molecule is characterized in that the first polypeptide comprises the amino acid sequence selected from the group consisting of SEQ ID NO:5, SEQ ID NO:97, SEQ ID NO:98 and SEQ ID NO:99 and in that the second polypeptide comprises the amino acid sequence selected from the group consisting of SEQ ID NO:1, SEQ ID NO:96, SEQ ID NO:3 and SEQ ID NO:4.

In one aspect, the TNF family ligand trimer-containing antigen binding molecule of the invention comprises
(a) at least one moiety capable of specific binding to a target cell antigen and
(b) a first and a second polypeptide that are linked to each other by a disulfide bond,
wherein the antigen binding molecule is characterized in that the first polypeptide comprises the amino acid sequence of SEQ ID NO:5 and in that the second polypeptide comprises the amino acid sequence of SEQ ID NO:6.

In a further aspect, the TNF family ligand trimer-containing antigen binding molecule of the invention comprises
(a) at least one moiety capable of specific binding to a target cell antigen and
(b) a first and a second polypeptide that are linked to each other by a disulfide bond,
wherein the antigen binding molecule is characterized in that the first polypeptide comprises the amino acid sequence of SEQ ID NO:5 and in that the second polypeptide comprises the amino acid sequence of SEQ ID NO:183.

In yet a further aspect, the TNF family ligand trimer-containing antigen binding molecule of the invention comprises
(a) at least one moiety capable of specific binding to a target cell antigen and
(b) a first and a second polypeptide that are linked to each other by a disulfide bond,
wherein the antigen binding molecule is characterized in that the first polypeptide comprises the amino acid sequence of SEQ ID NO:97 and in that the second polypeptide comprises the amino acid sequence of SEQ ID NO:184 or SEQ ID NO:185.

In another aspect, the TNF family ligand trimer-containing antigen binding molecule of the invention comprises
(a) at least one moiety capable of specific binding to a target cell antigen,
(b) a first polypeptide containing a CH1 or CL domain and a second polypeptide containing a CL or CH1 domain, respectively, wherein the second polypeptide is linked to the first polypeptide by a disulfide bond between the CH1 and CL domain,
and wherein the antigen binding molecule is characterized in that the first polypeptide comprises two ectodomains of a TNF ligand family member or two fragments thereof that are connected to each other and to the CH1 or CL domain by a peptide linker and in that the second polypeptide comprises only one ectodomain of said TNF ligand family member or a fragment thereof connected by a peptide linker to the CL or CH1 domain of said polypeptide.

In one aspect, provided is a TNF family ligand trimer-containing antigen binding molecule comprising
(a) at least one moiety capable of specific binding to a target cell antigen,
(b) a first polypeptide containing a CH1 domain and a second polypeptide containing a CL domain, wherein the second polypeptide is linked to the first polypeptide by a disulfide bond between the CH1 and CL domain,
and wherein the antigen binding molecule is characterized in that the first polypeptide comprises two ectodomains of a TNF ligand family member or fragments thereof that are connected to each other and to the CH1 domain by a peptide linker and in that the second polypeptide comprises one ectodomain of said TNF ligand family member or a fragment thereof connected via a peptide linker to the CL domain of said polypeptide.

In another aspect, provided is a TNF family ligand trimer-containing antigen binding molecule comprising
(a) at least one moiety capable of specific binding to a target cell antigen,
(b) a first polypeptide containing a CL domain and a second polypeptide containing a CH1 domain, wherein the second polypeptide is linked to the first polypeptide by a disulfide bond between the CH1 and CL domain,
and wherein the antigen binding molecule is characterized in that the first polypeptide comprises two ectodomains of a TNF ligand family member or fragments thereof that are connected to each other and to the CL domain by a peptide linker and in that the second polypeptide comprises one ectodomain of said TNF ligand family member or a fragment thereof connected via a peptide linker to the CH1 domain of said polypeptide.

In a further aspect, the invention provides a TNF family ligand trimer-containing antigen binding molecule as defined herein before, wherein the moiety capable of specific binding to a target cell antigen is selected from the group consisting of an antibody, an antibody fragment and a scaffold antigen binding protein.

In one aspect, the invention provides a TNF family ligand trimer-containing antigen binding molecule as defined herein before, wherein the moiety capable of specific binding to a target cell antigen is an antibody fragment.

In particular, the moiety capable of specific binding to a target cell antigen is selected from the group consisting of an antibody fragment, a Fab molecule, a crossover Fab molecule, a single chain Fab molecule, a Fv molecule, a scFv molecule, a single domain antibody, an aVH and a scaffold antigen binding protein.

In one aspect, the invention provides a TNF family ligand trimer-containing antigen binding molecule as defined herein before, wherein the moiety capable of specific binding to a target cell antigen is a scaffold antigen binding protein.

In a particular aspect, the invention is concerned with a TNF family ligand trimer-containing antigen binding molecule as defined above, wherein the moiety capable of specific binding to a target cell antigen is a Fab molecule capable of specific binding to a target cell antigen.

The invention provides a TNF family ligand trimer-containing antigen binding molecule that comprises at least one moiety capable of specific binding to a target cell antigen. In a particular aspect, the TNF family ligand trimer-containing antigen binding molecule comprises one moiety capable of specific binding to a target cell antigen. In another aspect, the invention provides a TNF family ligand trimer-containing antigen binding molecule comprising two moieties capable of specific binding to a target cell antigen.

In another aspect, provided is a TNF family ligand trimer-containing antigen binding molecule of the invention, wherein the target cell antigen is selected from the group consisting of Fibroblast Activation Protein (FAP), Carcinoembryonic Antigen (CEA), Melanoma-associated Chondroitin Sulfate Proteoglycan (MCSP), Epidermal Growth Factor Receptor (EGFR), CD19, CD20 and CD33.

In a particular aspect, the target cell antigen is Fibroblast Activation Protein (FAP).

In one aspect, the invention provides a TNF family ligand trimer-containing antigen binding molecule, wherein the moiety capable of specific binding to FAP comprises a VH domain comprising (i) CDR-H1 comprising the amino acid sequence of SEQ ID NO:7 or SEQ ID NO:100, (ii) CDR-H2 comprising the amino acid sequence of SEQ ID NO:8 or SEQ ID NO:101, and (iii) CDR-H3 comprising the amino acid sequence of SEQ ID NO:9 or SEQ ID NO:102, and a VL domain comprising (iv) CDR-L1 comprising the amino acid sequence of SEQ ID NO:10 or SEQ ID NO:103, (v) CDR-L2 comprising the amino acid sequence of SEQ ID NO:11 or SEQ ID NO:104, and (vi) CDR-L3 comprising the amino acid sequence of SEQ ID NO:12 or SEQ ID NO:105.

In one aspect, the invention provides a TNF family ligand trimer-containing antigen binding molecule, wherein the moiety capable of specific binding to FAP comprises a VH domain comprising (i) CDR-H1 comprising the amino acid sequence of SEQ ID NO:7, (ii) CDR-H2 comprising the amino acid sequence of SEQ ID NO:8 and (iii) CDR-H3 comprising the amino acid sequence of SEQ ID NO:9, and a VL domain comprising (iv) CDR-L1 comprising the amino acid sequence of SEQ ID NO:10, (v) CDR-L2 comprising the amino acid sequence of SEQ ID NO:11 and (vi) CDR-L3 comprising the amino acid sequence of SEQ ID NO:12.

In a particular aspect, the invention provides a TNF family ligand trimer-containing antigen binding molecule, wherein the moiety capable of specific binding to FAP comprises a VH domain comprising (i) CDR-H1 comprising the amino acid sequence of SEQ ID NO:100, (ii) CDR-H2 comprising the amino acid sequence SEQ ID NO:101, and (iii) CDR-H3 comprising the amino acid sequence of SEQ ID NO:102, and a VL domain comprising (iv) CDR-L1 comprising the amino acid sequence of SEQ ID NO:103, (v) CDR-L2 comprising the amino acid sequence of SEQ ID NO:104, and (vi) CDR-L3 comprising the amino acid sequence of SEQ ID NO:105.

In one aspect, provided is a TNF family ligand trimer-containing antigen binding molecule as defined herein before, wherein the moiety capable of specific binding to FAP comprises a variable heavy chain comprising an amino acid sequence of SEQ ID NO:16 and a variable light chain comprising an amino acid sequence of SEQ ID NO:17 or wherein the moiety capable of specific binding to FAP comprises a variable heavy chain comprising an amino acid sequence of SEQ ID NO:106 and a variable light chain comprising an amino acid sequence of SEQ ID NO:107.

In a further aspect, provided is a TNF family ligand trimer-containing antigen binding molecule according to the invention, wherein a peptide comprising two ectodomains of a TNF ligand family member or fragments thereof connected to each other by a first peptide linker is fused at its C-terminus to the CH1 or CL domain of a heavy chain by a second peptide linker and wherein one ectodomain of said TNF ligand family member or a fragment thereof is fused at the its C-terminus the CL or CH1 domain on a light chain by a third peptide linker.

In a particular aspect, the invention relates to a TNF family ligand trimer-containing antigen binding molecule as defined above, wherein the peptide linker is $(G_4S)_2$, i.e. a peptide linker of SEQ ID NO:13. In one aspect, the first peptide linker is $(G_4S)_2$ (SEQ ID NO:13), the second peptide linker is GSPGSSSSGS (SEQ ID NO:57) and the third peptide linker is $(G_4S)_2$ (SEQ ID NO:13). In another aspect, the first, the second and the third peptide linker is $(G_4S)_2$ (SEQ ID NO:13).

The invention is further concerned with a TNF family ligand trimer-containing antigen binding molecule as defined herein before, comprising an Fc domain composed of a first and a second subunit capable of stable association.

In particular, the TNF family ligand trimer-containing antigen binding molecule of the invention comprising (c) an Fc domain composed of a first and a second subunit capable of stable association further comprises (a) a Fab molecule capable of specific binding to a target cell antigen, wherein the Fab heavy chain is fused at the C-terminus to the N-terminus of a CH2 domain in the Fc domain.

In a further aspect, the Fc domain is an IgG, particularly an IgG1 Fc domain or an IgG4 Fc domain. More particularly, the Fc domain is an IgG1 Fc domain. In a particular aspect, the Fc domain comprises a modification promoting the association of the first and second subunit of the Fc domain.

In another aspect, the invention is concerned with a TNF family ligand trimer-containing antigen binding molecule as defined herein before, comprising
(c) an Fc domain composed of a first and a second subunit capable of stable association, wherein the Fc domain comprises one or more amino acid substitution that reduces binding to an Fc receptor, in particular towards Fcγ receptor.

In particular, the Fc domain comprises amino acid substitutions at positions 234 and 235 (EU numbering) and/or 329 (EU numbering) of the IgG heavy chains. More particularly, provided is a trimeric TNF family ligand-containing antigen binding molecule according to the invention which comprises an IgG1 Fc domain with the amino acid substitutions L234A, L235A and P329G (EU numbering).

In a further aspect, the invention provides a TNF family ligand trimer-containing antigen binding molecule, wherein the antigen binding molecule comprises a first heavy chain and a first light chain, both comprising a Fab molecule capable of specific binding to a target cell antigen,
a first peptide comprising two ectodomains of a TNF ligand family member or fragments thereof connected to each other by a first peptide linker fused at its C-terminus by a second peptide linker to a second heavy or light chain,
and a second peptide comprising one ectodomain of said TNF ligand family member fused at its C-terminus by a third peptide linker to a second light or heavy chain, respectively.

In another aspect, provided is a TNF family ligand trimer-containing antigen binding molecule, wherein the first peptide comprising two ectodomains of a TNF ligand family member or fragments thereof connected to each other by a first peptide linker is fused at its C-terminus by a second peptide linker to a CH1 domain that is part of a heavy chain, and the second peptide comprising one ectodomain of said TNF ligand family member or a fragment thereof is fused at its C-terminus by a third peptide linker to a CL domain that is part of a light chain.

In yet another aspect, provided is a TNF family ligand trimer-containing antigen binding molecule, wherein the first peptide comprising two ectodomains of a TNF ligand family member or fragments thereof connected to each other by a first peptide linker is fused at its C-terminus by a second peptide linker to a CL domain that is part of a heavy chain, and the second peptide comprising one ectodomain of said TNF ligand family member or a fragment thereof is fused at its C-terminus by a third peptide linker to a CH1 domain that is part of a light chain.

In a further aspect, the invention provides a TNF family ligand trimer-containing antigen binding molecule, wherein the first peptide comprising two ectodomains of a TNF ligand family member or fragments thereof connected to each other by a first peptide linker is fused at its C-terminus by a second peptide linker to a VH domain that is part of a heavy chain, and the second peptide comprising one ectodomain of said TNF ligand family member or a fragment thereof is fused at its C-terminus by a third peptide linker to a VL domain that is part of a light chain.

Provided is further a TNF family ligand trimer-containing antigen binding molecule, wherein in the CL domain adjacent to the TNF ligand family member the amino acid at position 123 (EU numbering) has been replaced by arginine (R) and the amino acid at position 124 (EU numbering) has been substituted by lysine (K), and wherein in the CH1 domain adjacent to the TNF ligand family member the amino acids at position 147 (EU numbering) and at position 213 (EU numbering) have been substituted by glutamic acid (E).

In a further aspect, provided is a TNF family ligand trimer-containing antigen binding molecule as described herein before, wherein the antigen binding molecule comprises
(a) a first heavy chain and a first light chain, both comprising a Fab molecule capable of specific binding to a target cell antigen,
(b) a second heavy chain comprising an amino acid sequence selected from the group consisting of SEQ ID NO:5, SEQ ID NO:97, SEQ ID NO:98 and SEQ ID NO:99, and a second light chain comprising an amino acid sequence selected from the group consisting of SEQ ID NO:1, SEQ ID NO:96, SEQ ID NO:3 and SEQ ID NO:4.

In one aspect, the invention provides a TNF family ligand trimer-containing antigen binding molecule, wherein the antigen binding molecule comprises
(a) a Fab molecule capable of specific binding to FAP, and
(b) a second heavy chain comprising an amino acid sequence selected from the group consisting of SEQ ID NO:5, SEQ ID NO:97, SEQ ID NO:98 and SEQ ID NO:99, and
a second light chain comprising an amino acid sequence selected from the group consisting of SEQ ID NO:1, SEQ ID NO:96, SEQ ID NO:3 and SEQ ID NO:4.

In a particular aspect, the invention provides a TNF family ligand trimer-containing antigen binding molecule comprising a moiety capable of specific binding to FAP. In one aspect, provided is a TNF family ligand trimer-containing antigen binding molecule, wherein the antigen binding molecule comprises
(i) a first heavy chain comprising the VH domain comprising the amino acid sequence of SEQ ID NO:16 and a first light chain comprising the VL domain comprising the amino acid sequence of SEQ ID NO:17 or
a first heavy chain comprising the VH domain comprising the amino acid sequence of SEQ ID NO:106 and a first light chain comprising the VL domain comprising the amino acid sequence of SEQ ID NO:107,
(ii) a second heavy chain comprising the amino acid sequence selected from the group consisting of SEQ ID NO:14, SEQ ID NO:108, SEQ ID NO:111, SEQ ID NO:113, SEQ ID NO.115, SEQ ID NO:139 and SEQ ID NO:148, and
(iii) a second light chain comprising the amino acid sequence of SEQ ID NO:15, SEQ ID NO:109, SEQ ID NO:110, SEQ ID NO:112, SEQ ID NO:114 and SEQ ID NO:115.

In another aspect, the invention provides a TNF family ligand trimer-containing antigen binding molecule, wherein the antigen binding molecule comprises
(i) a first heavy chain comprising the VH domain comprising the amino acid sequence of SEQ ID NO:16 and a first light chain comprising the VL domain comprising the amino acid sequence of SEQ ID NO:17 or
a first heavy chain comprising the VH domain comprising the amino acid sequence of SEQ ID NO:106 and a first light chain comprising the VL domain comprising the amino acid sequence of SEQ ID NO:107,
(ii) a second heavy chain comprising the amino acid sequence selected from the group consisting of SEQ ID NO:115, SEQ ID NO:117, SEQ ID NO:119 and SEQ ID NO:173, and
(iii) a second light chain comprising the amino acid sequence selected from the group consisting of SEQ ID NO:116, SEQ ID NO:118, SEQ ID NO:120 and SEQ ID NO:174.

In yet another aspect, the invention provides a TNF family ligand trimer-containing antigen binding molecule, comprising
(a) at least one moiety capable of specific binding to a target cell antigen, and
(b) a first and a second polypeptide that are linked to each other by a disulfide bond,
wherein the antigen binding molecule is characterized in that the first polypeptide contains a CH3 domain and the second polypeptide contains a CH3 domain, respectively, and wherein the first polypeptide comprises two ectodomains of a TNF ligand family member or fragments thereof that are connected to each other and to the C-terminus of the CH3 domain by a peptide linker and wherein the second polypeptide comprises one ectodomain of said TNF ligand family member or a fragment thereof connected via a peptide linker to C-terminus of the CH3 domain of said polypeptide.

In particular, such a TNF family ligand trimer-containing antigen binding molecule comprises two moieties capable of specific binding to a target cell antigen.

In one aspect, the invention provides a TNF family ligand trimer-containing antigen binding molecule comprising two moieties capable of specific binding to FAP. In particular, provided is a TNF family ligand trimer-containing antigen binding molecule as described herein before comprises
(i) a first heavy chain comprising the amino acid sequence of SEQ ID NO:121, a second heavy chain comprising the amino acid sequence of SEQ ID NO:122, and two light chains comprising the amino acid sequence of SEQ ID NO:19, or
(ii) a first heavy chain comprising the amino acid sequence of SEQ ID NO:123, a second heavy chain comprising the amino acid sequence of SEQ ID NO:124, and two light chains comprising the amino acid sequence of SEQ ID NO:125, or
(iii) a first heavy chain comprising the amino acid sequence of SEQ ID NO:126, a second heavy chain comprising the amino acid sequence of SEQ ID NO:127, and two light chains comprising the amino acid sequence of SEQ ID NO:125.

In another particular aspect, the invention provides a TNF family ligand trimer-containing antigen binding molecule as described herein before, wherein the target cell antigen is CD19.

In one aspect, provided is a TNF family ligand trimer-containing antigen binding molecule, wherein the moiety capable of specific binding to CD19 comprises a VH domain comprising (i) CDR-H1 comprising the amino acid sequence of SEQ ID NO:195 or SEQ ID NO:252, (ii) CDR-H2 comprising the amino acid sequence of SEQ ID NO:196 or SEQ ID NO:253, and (iii) CDR-H3 comprising the amino acid sequence of SEQ ID NO:197 or SEQ ID NO:254, and a VL domain comprising (iv) CDR-L1 comprising the amino acid sequence of SEQ ID NO:198 or SEQ ID NO:249, (v) CDR-L2 comprising the amino acid sequence of SEQ ID NO:199 or SEQ ID NO:250, and (vi) CDR-L3 comprising the amino acid sequence of SEQ ID NO:200 or SEQ ID NO:251.

In a further aspect, provided is a TNF family ligand trimer-containing antigen binding molecule, wherein the moiety capable of specific binding to CD19 comprises a variable heavy chain comprising an amino acid sequence of SEQ ID NO:201 and a variable light chain comprising an amino acid sequence of SEQ ID NO:202 or wherein the moiety capable of specific binding to FAP comprises a variable heavy chain comprising an amino acid sequence of SEQ ID NO:357 and a variable light chain comprising an amino acid sequence of SEQ ID NO:358.

In a particular aspect, provided is a TNF family ligand trimer-containing antigen binding molecule, wherein the antigen binding molecule comprises
(i) a first heavy chain comprising the VH domain comprising the amino acid sequence of SEQ ID NO:201 and a first light chain comprising the VL domain comprising the amino acid sequence of SEQ ID NO:202 or
a first heavy chain comprising the VH domain comprising the amino acid sequence of SEQ ID NO:357 and a first light chain comprising the VL domain comprising the amino acid sequence of SEQ ID NO:358,
(ii) a second heavy chain comprising the amino acid sequence selected from the group consisting of SEQ ID NO:14, SEQ ID NO:108, SEQ ID NO:111 and SEQ ID NO:113, and
(iii) a second light chain comprising the amino acid sequence of SEQ ID NO:15, SEQ ID NO:109, SEQ ID NO:110, SEQ ID NO:112 and SEQ ID NO:114.

In another aspect, provided is a TNF family ligand trimer-containing antigen binding molecule, wherein the antigen binding molecule comprises
(i) a first heavy chain comprising the VH domain comprising the amino acid sequence of SEQ ID NO:201 and a first light chain comprising the VL domain comprising the amino acid sequence of SEQ ID NO:202 or
a first heavy chain comprising the VH domain comprising the amino acid sequence of SEQ ID NO:357 and a first light chain comprising the VL domain comprising the amino acid sequence of SEQ ID NO:358,
(ii) a second heavy chain comprising the amino acid sequence selected from the group consisting of SEQ ID NO:115, SEQ ID NO:117, SEQ ID NO:119 and SEQ ID NO:173, and
(iii) a second light chain comprising the amino acid sequence selected from the group consisting of SEQ ID NO:116, SEQ ID NO:118, SEQ ID NO:120 and SEQ ID NO:174.

In one aspect, the invention provides a TNF family ligand trimer-containing antigen binding molecule comprising two moieties capable of specific binding to CD19. In particular, provided is a TNF family ligand trimer-containing antigen binding molecule of any one of claims 1 to 14, 29, 30 and 32 to 34, wherein the antigen binding molecule comprises
(i) a first heavy chain comprising the amino acid sequence of SEQ ID NO:209, a second heavy chain comprising the amino acid sequence of SEQ ID NO:210, and two light chains comprising the amino acid sequence of SEQ ID NO:206, or
(ii) a first heavy chain comprising the amino acid sequence of SEQ ID NO:213, a second heavy chain comprising the amino acid sequence of SEQ ID NO:214, and two light chains comprising the amino acid sequence of SEQ ID NO:206, or
(iii) a first heavy chain comprising the amino acid sequence of SEQ ID NO:309, a second heavy chain comprising the amino acid sequence of SEQ ID NO:310, and two light chains comprising the amino acid sequence of SEQ ID NO:279, or
(iv) a first heavy chain comprising the amino acid sequence of SEQ ID NO:313, a second heavy chain comprising the amino acid sequence of SEQ ID NO:314, and two light chains comprising the amino acid sequence of SEQ ID NO:279.

In another particular aspect, the invention provides a TNF family ligand trimer-containing antigen binding molecule as described herein before, wherein the target cell antigen is CEA.

In one aspect, provided is a TNF family ligand trimer-containing antigen binding molecule, wherein the moiety capable of specific binding to CEA comprises a VH domain comprising (i) CDR-H1 comprising the amino acid sequence of SEQ ID NO:321, (ii) CDR-H2 comprising the amino acid sequence of SEQ ID NO:322, and (iii) CDR-H3 comprising the amino acid sequence of SEQ ID NO:323, and a VL domain comprising (iv) CDR-L1 comprising the amino acid sequence of SEQ ID NO:324, (v) CDR-L2 comprising the amino acid sequence of SEQ ID NO:325, and (vi) CDR-L3 comprising the amino acid sequence of SEQ ID NO:326.

In another aspect, provided is a TNF family ligand trimer-containing antigen binding molecule, wherein the moiety capable of specific binding to CEA comprises a variable heavy chain comprising an amino acid sequence of SEQ ID NO:329 and a variable light chain comprising an amino acid sequence of SEQ ID NO:330.

In one aspect, provided is a TNF family ligand trimer-containing antigen binding molecule as described herein before, wherein the antigen binding molecule comprises
(i) a first heavy chain comprising the VH domain comprising the amino acid sequence of SEQ ID NO:329 and a first light chain comprising the VL domain comprising the amino acid sequence of SEQ ID NO:330, (ii) a second heavy chain comprising the amino acid sequence selected from the group consisting of SEQ ID NO:14, SEQ ID NO:108, SEQ ID NO:111 and SEQ ID NO:113, and
(iii) a second light chain comprising the amino acid sequence of SEQ ID NO:15, SEQ ID NO:109, SEQ ID NO:110, SEQ ID NO:112 and SEQ ID NO:114.

In another aspect, provided is a TNF family ligand trimer-containing antigen binding molecule, wherein the antigen binding molecule comprises
(i) a first heavy chain comprising the VH domain comprising the amino acid sequence of SEQ ID NO:329 and a first light chain comprising the VL domain comprising the amino acid sequence of SEQ ID NO:330,
(ii) a second heavy chain comprising the amino acid sequence selected from the group consisting of SEQ ID NO:115, SEQ ID NO:117, SEQ ID NO:119 and SEQ ID NO:173, and
(iii) a second light chain comprising the amino acid sequence selected from the group consisting of SEQ ID NO:116, SEQ ID NO:118, SEQ ID NO:120 and SEQ ID NO:174.

In one aspect, the invention provides a TNF family ligand trimer-containing antigen binding molecule comprising two moieties capable of specific binding to CEA. Particularly, provided is a TNF family ligand trimer-containing antigen binding molecule, wherein the antigen binding molecule comprises
(i) a first heavy chain comprising the amino acid sequence of SEQ ID NO:337, a second heavy chain comprising the amino acid sequence of SEQ ID NO:338, and two light chains comprising the amino acid sequence of SEQ ID NO:334, or
(ii) a first heavy chain comprising the amino acid sequence of SEQ ID NO:341, a second heavy chain comprising the amino acid sequence of SEQ ID NO:342, and two light chains comprising the amino acid sequence of SEQ ID NO:334.

In a further aspect, provided is aTNF family ligand trimer-containing antigen binding molecule as described herein before, wherein the TNF ligand family member is OX40L. In one aspect, provided is TNF family ligand trimer-containing antigen binding molecule, wherein the ectodomain of a TNF ligand family member comprises the amino acid sequence of SEQ ID NO:53 or SEQ ID NO:54, particularly the amino acid sequence of SEQ ID NO:53.

In a further aspect, provided is a TNF family ligand trimer-containing antigen binding molecule of any one of claims 1 to 5, 10 to 24, 29, 30, 32 to 34, 38 to 40, 44 and 45, comprising
(a) at least one moiety capable of specific binding to a target cell antigen and
(b) a first and a second polypeptide that are linked to each other by a disulfide bond,
wherein the antigen binding molecule is characterized in that the first polypeptide comprises the amino acid sequence of SEQ ID NO:371 or SEQ ID:372 and in that the second polypeptide comprises the amino acid sequence of SEQ ID NO:53 or SEQ ID NO:54.

In another aspect, provided is a TNF family ligand trimer-containing antigen binding molecule, wherein the target cell antigen is Fibroblast Activation Protein (FAP) and the moiety capable of specific binding to FAP comprises a VH domain comprising (i) CDR-H1 comprising the amino acid sequence of SEQ ID NO:7 or SEQ ID NO:100, (ii) CDR-H2 comprising the amino acid sequence of SEQ ID NO:8 or SEQ ID NO:101, and (iii) CDR-H3 comprising the amino acid sequence of SEQ ID NO:9 or SEQ ID NO:102, and a VL domain comprising (iv) CDR-L1 comprising the amino acid sequence of SEQ ID NO:10 or SEQ ID NO:103, (v) CDR-L2 comprising the amino acid sequence of SEQ ID NO:11 or SEQ ID NO:104, and (vi) CDR-L3 comprising the amino acid sequence of SEQ ID NO:12 or SEQ ID NO:105.

Particularly, provided is a TNF family ligand trimer-containing antigen binding molecule as described herein, wherein the antigen binding molecule comprises
(i) a first heavy chain comprising the VH domain comprising the amino acid sequence of SEQ ID NO:16 and a first light chain comprising the VL domain comprising the amino acid sequence of SEQ ID NO:17 or
a first heavy chain comprising the VH domain comprising the amino acid sequence of SEQ ID NO:106 and a first light chain comprising the VL domain comprising the amino acid sequence of SEQ ID NO:107,
(ii) a second heavy chain comprising the amino acid sequence selected from the group consisting of SEQ ID NO:355, and
(iii) a second light chain comprising the amino acid sequence of SEQ ID NO:356.

According to another aspect of the invention, there is provided an isolated polynucleotide encoding a TNF family ligand trimer-containing antigen binding molecule as defined herein before. The invention further provides a vector, particularly an expression vector, comprising the isolated polynucleotide of the invention and a host cell comprising the isolated polynucleotide or the vector of the invention. In some embodiments the host cell is a eukaryotic cell, particularly a mammalian cell.

In another aspect, provided is a method for producing the TNF family ligand trimer-containing antigen binding molecule of the invention, comprising the steps of (i) culturing the host cell of the invention under conditions suitable for expression of the antigen binding molecule, and (ii) recovering the antigen binding molecule. The invention also encompasses a TNF family ligand trimer-containing antigen binding molecule produced by the method of the invention.

The invention further provides a pharmaceutical composition comprising the TNF family ligand trimer-containing antigen binding molecule of the invention and at least one pharmaceutically acceptable excipient.

Also encompassed by the invention is the TNF family ligand trimer-containing antigen binding molecule of the invention, or the pharmaceutical composition of the invention, for use as a medicament. In one aspect is provided the TNF family ligand trimer-containing antigen binding molecule of the invention, or the pharmaceutical composition of the invention, for use in the treatment of a disease in an individual in need thereof. In a specific embodiment, provided is the TNF family ligand trimer-containing antigen binding molecule of the invention, or the pharmaceutical composition of the invention, for use in the treatment of cancer.

Also provided is the use of the TNF family ligand trimer-containing antigen binding molecule of the invention for the manufacture of a medicament for the treatment of a disease in an individual in need thereof, in particular for the manufacture of a medicament for the treatment of cancer, as well as a method of treating a disease in an individual, comprising administering to said individual a therapeutically effective amount of a composition comprising the TNF family ligand trimer-containing antigen binding molecule of the invention in a pharmaceutically acceptable form. In a specific embodiment, the disease is cancer. In any of the above embodiments the individual is preferably a mammal, particularly a human.

BRIEF DESCRIPTION OF THE DRAWINGS

FIG. 1A shows the dimeric ligand that is fused at the C-terminus to a human CH1 or CL domain or a VL or VH domain and FIG. 1B shows the monomeric ligand fused to human CL or CH1 domain or a VL or VH domain. FIG. 1C shows the dimeric ligand that is fused at the N-terminus to a human CH3 domain and FIG. 1D shows the monomeric ligand fused at the N-terminus to a human CH3 domain.

FIGS. 2A to 2J show the 4-1BBL-trimer-containing antigen binding molecules Constructs 1.1 to 1.10 of the invention. The preparation and production of these constructs is described in Example 1. The VH and VL domains are those of anti-FAP antibody 28H1, the thick black point stands for the knob-into-hole modification. * symbolizes amino acid modifications in the CH1 and CL domain (so-called charged residues).

FIG. 3A) shows the dimeric ligand that is fused at the C-terminus to murine CL domain and FIG. 3B) shows the monomeric ligand fused at the C-terminus to murine CH1 domain. Components for the assembly of FAP targeted split trimeric murine 4-1BB ligand. FIG. 3C) shows the assembled murine 4-1BBL-trimer-containing antigen binding molecules as described in more detail in Example 1.3.

FIGS. 4A to 4F show the 4-1BBL-trimer-containing antigen binding molecules Constructs 2.1 to 2.6 of the invention. The preparation and production of these constructs is described in Example 2. The VH and VL domains are those of anti-FAP antibody 4B9, the thick black point stands for the knob-into-hole modification. * symbolizes amino acid modifications in the CH1 and CL domain (so-called charged residues).

FIGS. 6A-1 to 6C-2 relate to the binding of FAP-targeted 4-1BB ligand trimer-containing Fc(kih) fusion antigen binding molecule (FAP split 4-1BBL trimer, filled circles) or DP-47 untargeted 4-1BB ligand trimer-containing Fc(kih) fusion antigen binding molecule (DP47 split 4-1BBL trimer, open circles) to resting (naïve) or activated human PMBCs. Specifically, the binding to resting (naïve) or activated human CD8+ T cells is shown in FIGS. 6A-1 and 6A-2, to resting (naïve) or activated human CD4+ T cells in FIGS. 6B-1 and 6B-2 and to resting (naïve) or activated human NK cells in FIGS. 6-C1 and 6-C2. Shown is the binding as Median of fluorescence intensity (MFI) of red macrophytic algae Phycoerythrin (R-PE)-labeled anti-human IgG Fcγ-specific goat IgG F(ab')2 fragment which is used as secondary detection antibody. MFI was measured by flow cytometry and baseline corrected by subtracting the MFI of the blank control.

FIGS. 7A-1 to 7B-4 show the binding of different FAP-targeted or untargeted split trimeric human 4-1BB ligand Fc (kih) constructs to human 4-1BB expressing T cells from PHA-L and Proleukin pre-activated and anti-human CD3/anti-human CD28 re-activated human PBMCs. Binding was detected with R-Phycoerythrin-fluorochrome conjugated anti-human IgG Fcγ-specific goat IgG F(ab')2 fragment. Shown is the median of fluorescence intensity (MFI) versus the concentration of tested Constructs 1.1 to 1.10 of Example 1. For a better display the binding curves are split in four different blots with Construct 1.1 (monovalent FAP-targeted split trimeric human 4-1BB ligand Fc (kih)) and Control B (monovalent untargeted split trimeric human 4-1BB ligand Fc (kih) with CH-CL cross and charged residues) as comparison curves. Binding was monitored on CD3+ CD8+ T cells (FIGS. 7A-1 to 7A-4) and CD3+ CD4+ T cells (FIGS. 7B-1 to 7B-4). The 4-1BB expression level on CD8 T cells is normally higher than on CD4 T cells. All versions bind with a quite similar affinity to human 4-1BB.

FIGS. 8A-1 to 8B-4 show the binding of different FAP-targeted or untargeted split trimeric human 4-1BB ligand Fc (kih) constructs to CD4+ or CD8+ T cells from fresh PBMCs (FIG. 8A-1 to 8A-4) or to human 4-1BB expressing PHA-L and Proleukin pre-activated and anti-human CD3/anti-human CD28 re-activated human PBMCs (FIG. 8B-1 to 8B-4). Binding was detected with R-Phycoerythrin-fluorochrome conjugated anti-human IgG Fcγ-specific goat IgG F(ab')2 fragment. Shown is the median of fluorescence intensity (MFI) versus the concentration of tested Constructs 2.1, 2.3, 2.4, 2.5 and 2.6 of Example 2 and control molecules Control B, Control C, Control E and Control F. For a better display the binding curves are split in two different blots with construct 2.1 (monovalent FAP-targeted split trimeric human 4-1BB ligand Fc (kih)) and control B (monovalent untargeted split trimeric human 4-1BB ligand Fc (kih) with CH-CL cross and charged residues) as comparison curves. Binding was monitored on CD45+ CD3+ CD8+ T cells (blots on the bottom) and CD45+ CD3+ CD4+ T cells (blots on the top). The 4-1BB expression level on CD8 T cells is normally higher than on CD4 T cells. All constructs bind with a quite similar affinity to human 4-1BB, whereas the bivalent construct 2.3 and its untargeted control C show a lower MFI. This can be due to sterical hindrance of 4-1BB-binding and/or less detection due to the 2nd detection antibody induced by the Fc-conjugated split 4-1BB ligand.

FIGS. 11A-1 to 11B-2 show the binding of different FAP-targeted or untargeted split trimeric human 4-1BB ligand Fc (kih) constructs to human-FAP expressing human melanoma MV-3 cells (FIG. 11A-1 to 11A-4) and/or NIH/3T3-huFAP clone 39 transfected mouse embryonic fibroblast cells (FIGS. 11B-1 and 11B-2). Binding was detected with R-Phycoerythrin-fluorochrome or fluorescein-fluorochrome conjugated anti-human IgG Fcγ-specific goat IgG F(ab')2 fragments. Shown is the median of fluorescence intensity (MFI) versus the concentration of tested constructs. For a better display binding curves were distributed to four (FIG. 11A-1 to 11A-4) or two blots (FIGS. 11B-1 and 11B-2), whereas construct 1.1 (monovalent FAP-targeted split trimeric human 4-1BB ligand Fc (kih)) is used a comparison curve. All constructs bind with a similar affinity to human FAP except the bivalent FAP-targeted constructs (constructs 1.5, 1.7 and 1.8). They showed a tendency to have lower EC50 values and lower median fluorescence intensity. This can be explained with their bivalent targeting (higher avidity, less molecules can bind at the same time due to occupancy of two epitopes resulting in a lower MFI). Structural differences may also explain the difference between Construct 1.8 (complete bivalent targeting) and Constructs 1.5 and 1.7 (only partial bivalent targeting).

FIGS. 12A-1 to 12B-2 show the binding of different FAP-targeted or untargeted split trimeric human 4-1BB ligand Fc (kih) Constructs 2.1, 2.3, 2.4, 2.5 and 2.6 to human-FAP expressing human melanoma MV-3 cells (FIGS. 12A-1 and 12A-2) and WM-266-4 cells (FIGS. 12B-1 and 12B-2). Binding was detected with R-Phycoerythrin-fluorochrome conjugated anti-human IgG Fcγ-specific goat IgG F(ab')2 fragments. Shown is the median of fluorescence intensity (MFI) versus the concentration of tested contructs. For a better display binding curves were distributed to two blots, whereas construct 2.1 (monovalent FAP-targeted split trimeric human 4-1BB ligand Fc (kih)) is used as comparison curve. All constructs bind with a similar affinity to human FAP except the bivalent FAP-targeted construct 2.3. It has a tendency to show lower EC50 values and lower median fluorescence intensity. This can be explained with its bivalent targeting, which results in higher avidity but less occupancy or FAP molecules on the cell surface resulting in a lower MFI.

FIGS. 13A-1 to 13B-2 show the binding of different FAP-targeted or untargeted split trimeric mouse 4-1BB ligand Fc (kih) constructs to CD4+ or CD8+ T cells from fresh splenocytes (FIGS. 13A-1 and 13A-2) or to mouse 4-1BB expressing anti-mouse CD3/anti-mouse CD28 monoclonal agonistic antibodies activated mouse splenocytes (FIGS. 13B-1 and 13B-2). Binding was detected with FITC-fluorochrome conjugated anti-mouse IgG Fcγ-specific goat IgG F(ab')2 fragment. Shown is the median of fluorescence intensity (MFI) versus the concentration of tested constructs. Binding was monitored on CD3+ CD8+ T cells (left blot) and CD3+ CD4+ T cells (right blot). The 4-1BB expression level on CD8 T cells is normally higher than on CD4 T cells. All constructs bind with a quite similar affinity to mouse 4-1BB.

FIGS. 15A and 15B show a scheme that illustrates the general principal of the NFκB activity assay described in Example 6.1 using a reporter cell line. Shown is the activation assay set up with human 4-1BB expressing HeLa reporter cell line. A crosslinking of 4-1BB expressed on the reporter cells induces NFκB activation and NFκB-mediated Luciferase expression. After lysis of the cells Luciferase can catalyze the oxidation of Luciferin to Oxyluciferin. This chemical reaction correlates positively with the strength of NFκB-mediated luciferase expression and can be measured by the strength of light emission (units of released light). The ratio of FAP-expressing tumor cells to the reporter cell line HeLa-huCD137-NFkB-luc was 5 to 1.

FIGS. 17A-1 to 17C-4 shows the NFκB-activation-induced Luciferase expression and activity as measured with the assay described in Example 6.1. Counts of released light per seconds (CPS) are measured for 0.5 s/well and plotted against the used concentration of FAP-targeted or untargeted split trimeric human 4-1BB ligand Fc (kih) constructs. Human 4-1BB-expressing HeLa-reporter cells were incubated for 6 h in the absence (FIGS. 17A-1 to 17A-4) or presence of crosslinking human-FAP expressing human melanoma cell line MV-3 (FIGS. 17B-1 to 17B-4) or WM-266-4 (FIGS. 17C-1 to 17C-4). CPS were measured and blotted against the concentrations of different FAP-targeted or untargeted split trimeric human 4-1BB ligand Fc (kih) Constructs. The cell ratio is one human 4-1BB-expressing HeLa reporter cell to five tumor cells. For better display, activation curves were split to four different display-blots with construct 1.1 (monovalent FAP-targeted split trimeric human 4-1BB ligand Fc (kih)) and control B (monovalent untargeted split trimeric human 4-1BB ligand Fc (kih) with CH-CL cross and charged residues) as comparison curves. FIGS. 17A-1 to 17D-4 show the activation without crosslinking FAP-expressing tumor cells, FIGS.

17B-1 to 17B-4 shows the activation in the presence of crosslinking FAP-expressing MV-3 tumor cells and FIG. 17C-1 to 17C-4 shows the activation in the presence of crosslinking FAP-expressing WM-266-4 tumor cells.

FIGS. 19A and 19B show the activation assay set up with cynomolgus monkey 4-1BB expressing T293-HEK reporter cell line. A crosslinking of cynomolgus monkey 4-1BB expressed on the reporter cells induces NFκB activation and NFκB-mediated Luciferase expression. After lysis of the cells Luciferase can catalyze the oxidation of Luciferin to Oxyluciferin. This chemical reaction correlates positively with the strength of NFκB-mediated luciferase expression and can be measured by the strength of light emission (units of released light).

FIGS. 22A-1 to 22E-3 and 23A-1 to 23E-3 relate to the Activation assay with HLA-A2-NLV-specific CD8 T cells and NLV-pulsed HLA-A2+ FAP+ human melanoma cell line MV-3 in the presence of different titrated concentration of different FAP-targeted or untargeted split trimeric human 4-1BB ligand Fc (kih) constructs as prepared in Example 1. For better display expression curves were split to several different display-blots with Construct 1.1 (monovalent FAP-targeted split trimeric human 4-1BB ligand Fc (kih)) and Control B (monovalent untargeted split trimeric human 4-1BB ligand Fc (kih)) as comparison curves. Results were obtained in four independent similar experiments and show that prolonged IFNγ secretion and CD137 expression of NLV-specific CD8+ T cells is strictly dependent on simultaneous activation of T-cells via recognition of NLV-HLA-A2 complexes (signal 1) and 4-1BB-triggering by FAP-targeted human split 4-1BBL (signal 2). The effect of 4-1BB upregulation is shown in graphs of FIGS. 22A-1 to 22E-3, whereas the effect of INFγ expression of CD8+ T cells is presented in graphs of FIGS. 23A-1 to 23E-3. Shown is always the frequency in percentage of positive cells in the total CD8+ T cell population. All FAP-targeted variants induced a similar activation improvement of NLV-peptide activated CD8 T cells shown in FIGS. 22A-1 to 22E-3—as 4-1BB-upregulation (positive feedback loop) and in FIGS. 23A-1 to 23E-3—as IFNγ expression after 24 h of stimulation. Differences of curves lie in the range of normal error deviation and are not significant.

FIGS. 24A-1 to 24B-3 and 25A-1 to 25B-3 refer to the Activation assay with HLA-A2-NLV-specific CD8 T cells and NLV-pulsed HLA-A2+ FAP+ human melanoma cell line MV-3 in the presence of titrated concentration of different FAP-targeted or untargeted split trimeric human 4-1BB ligand Fc (kih) constructs of Example 2. For better display expression curves were split to two different display-blots with Construct 2.1 (monovalent FAP-targeted split trimeric human 4-1BB ligand Fc (kih)) and Control B as comparison curves. All FAP-targeted split trimeric human 4-1BB ligand Fc (kih) constructs show a similar activation improvement of HLA-A2-NLV-peptide specific CD8 T cells shown in FIG. 24A-1 to 24B-3 as 4-1BB-upregulation (positive feedback loop) and in FIG. 25A-1 to 25B-3 as IFNγ expression after 24 h of stimulation. Differences of curves lie in the range of normal error deviation and are not significant.

FIG. 29A shows the dimeric ligand that is fused at the C-terminus to a human CL domain with mutations E123R and Q124K (charged residues) and FIG. 29B shows the monomeric 4-1BB ligand fused to human CH1 domain with mutations K147E and K213E (charged residues). Components for the assembly of bivalent CD19-targeted split trimeric human 4-1BB ligand (71-254) antigen binding molecule (construct 3.3). FIG. 29C shows the dimeric ligand being fused to the C-terminus of human IgG1 Fc hole chain. FIG. 29D shows the monomeric ligand being fused to the C-terminus of human IgG1 Fc knob chain.

Figures 1, 7A:
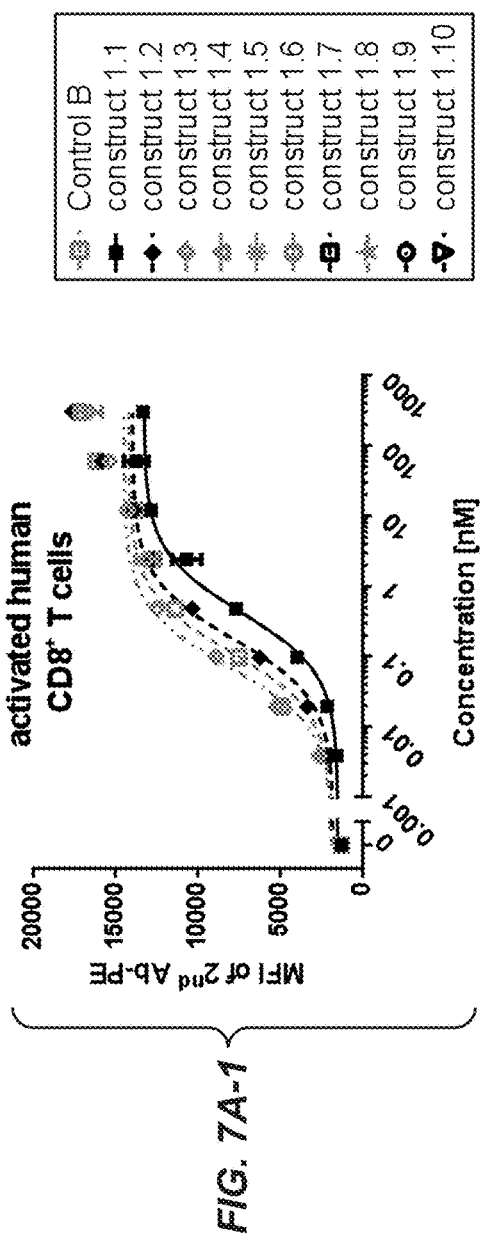
Figures 2, 7A:
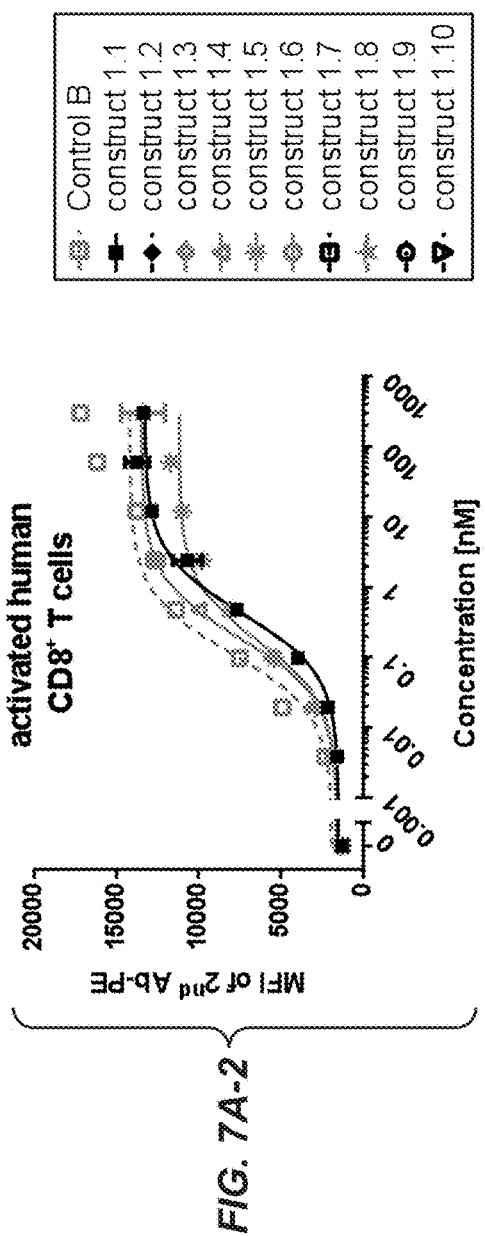
Figures 1, 7B:
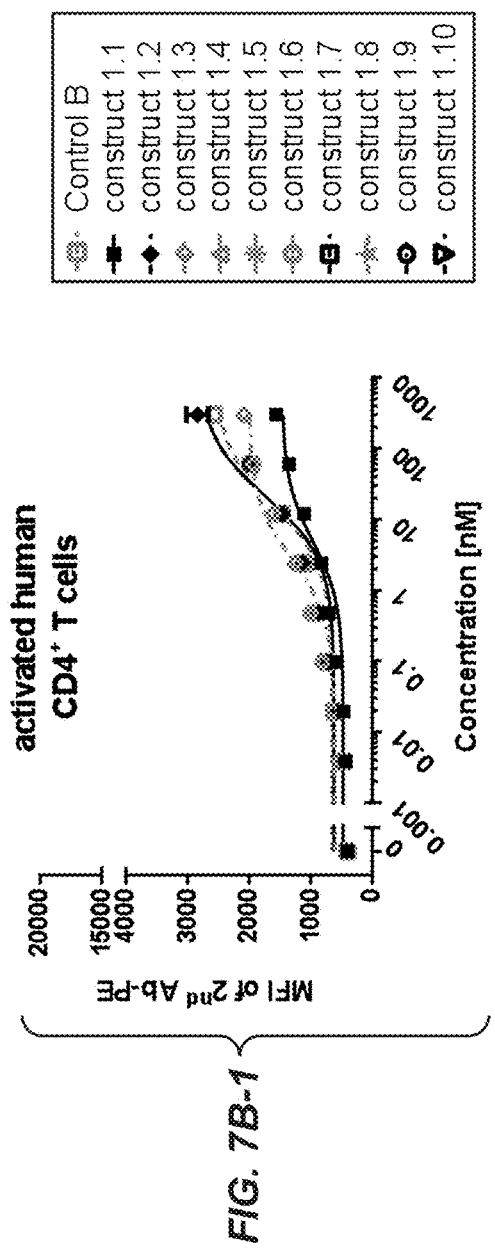
Figures 2, 7B:
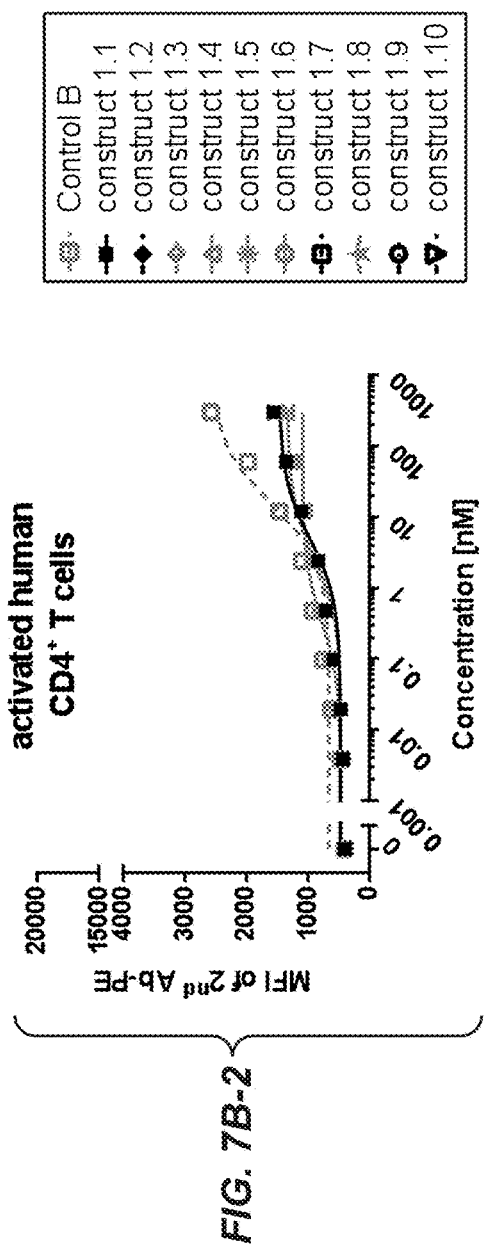

FIGS. 31A-1 to 31A-2 illustrates the randomization strategy for the CDR regions of the parental clone 8B8. Shown are the variable domains of the parental clone 8B8 and the CDR regions (boxed) according to the numbering of Kabat. (X) (SEQ ID NO:202; SEQ ID NO:201) represents the randomized positions. FIGS. 31B-1 to 31B-2 shows the schematic description of the library generation strategies. Shown is the PCR amplification and cloning strategy used for the generation of the 8B8-based library with A) randomized CDR1 and CDR2 regions in the light and heavy chain or B) randomized CDR1 and CDR3 regions in the light and CDR3 region in the heavy chain. Respective enzymes used for cloning into the phagemide are indicated.

Figure 32A:
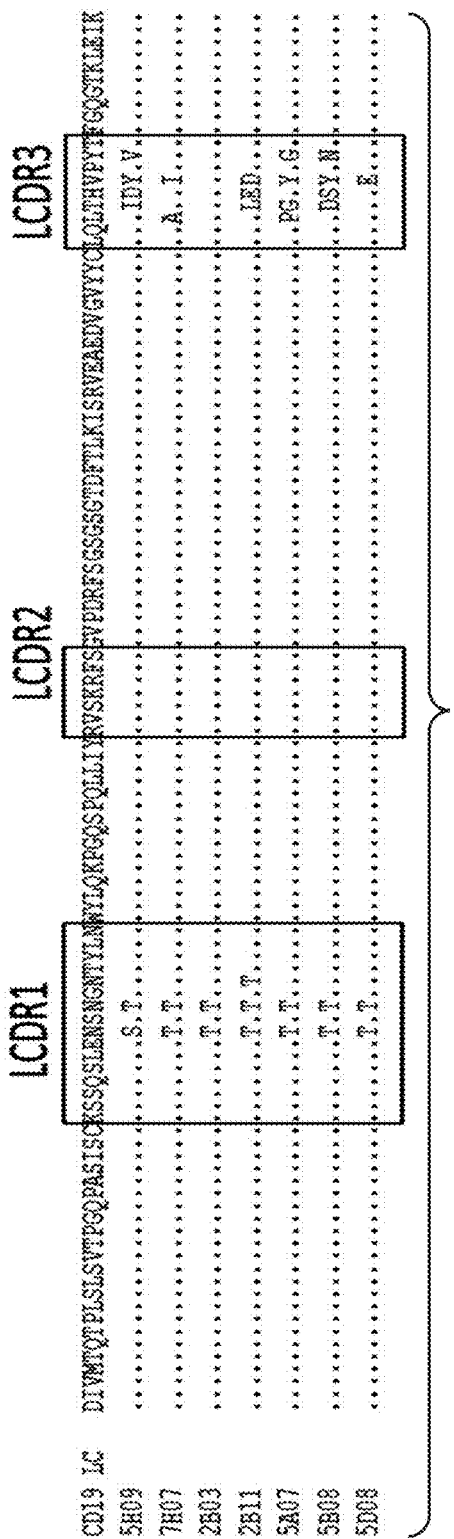
Figure 32B:
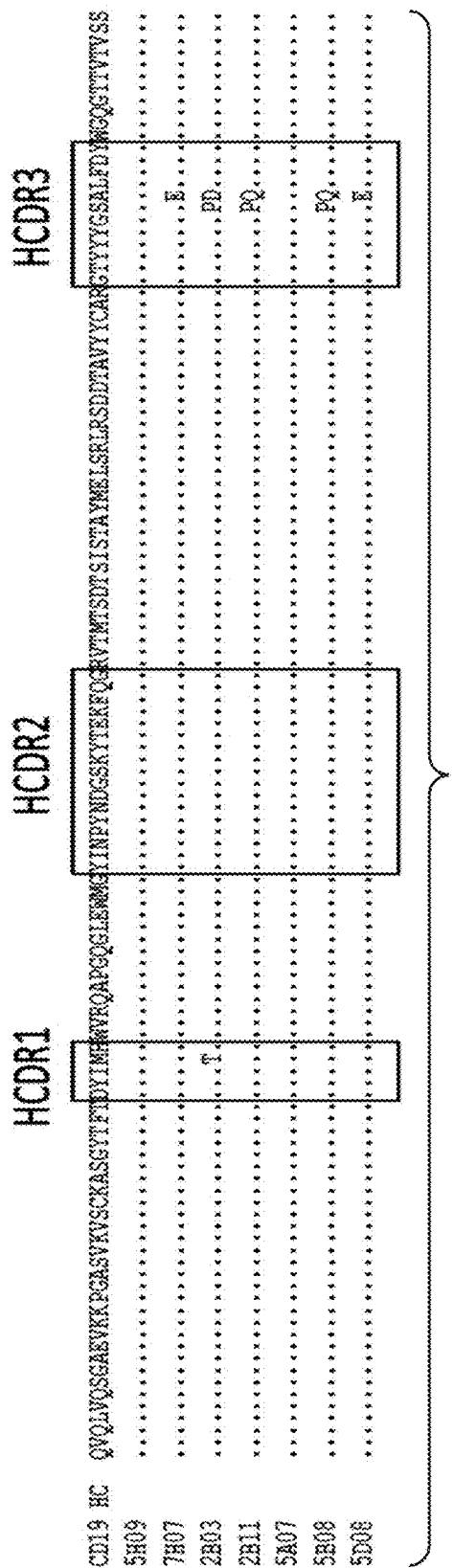
Figure 33A:
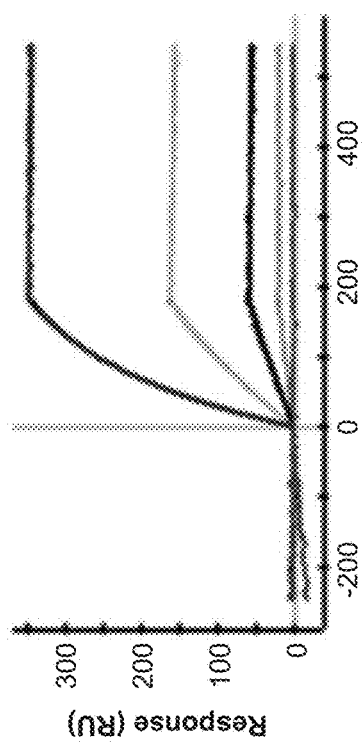
Figure 33B:
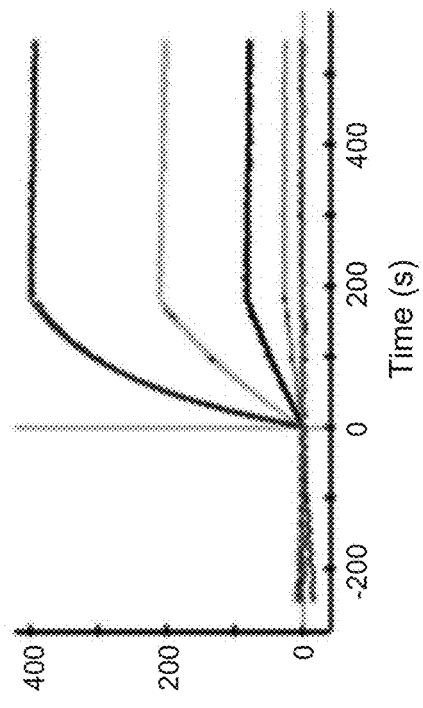
Figure 33C:
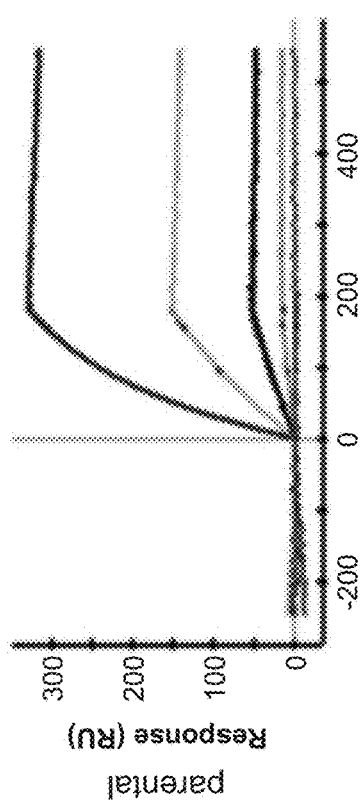
Figure 33D:
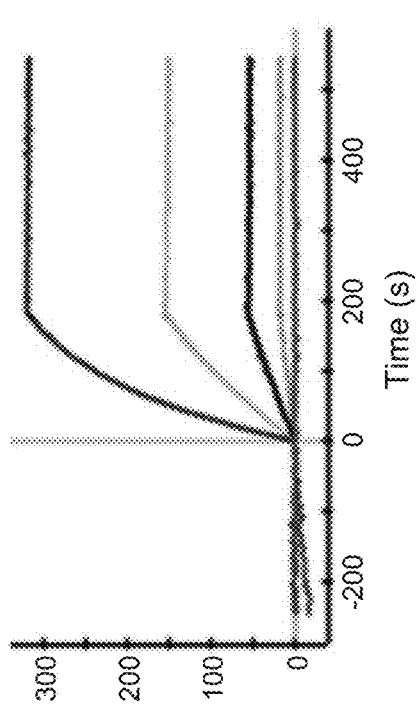
Figure 33E:
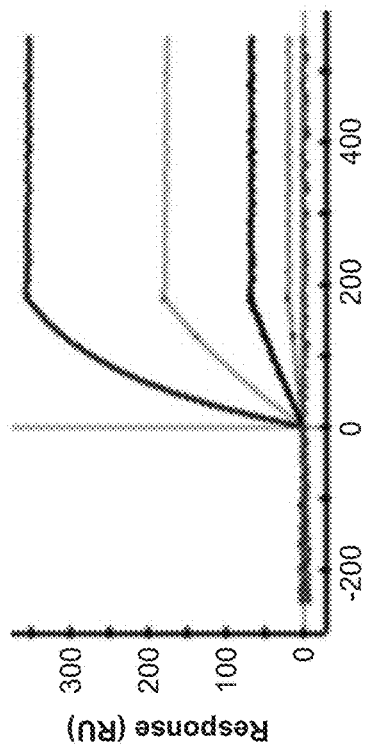
Figure 33F:
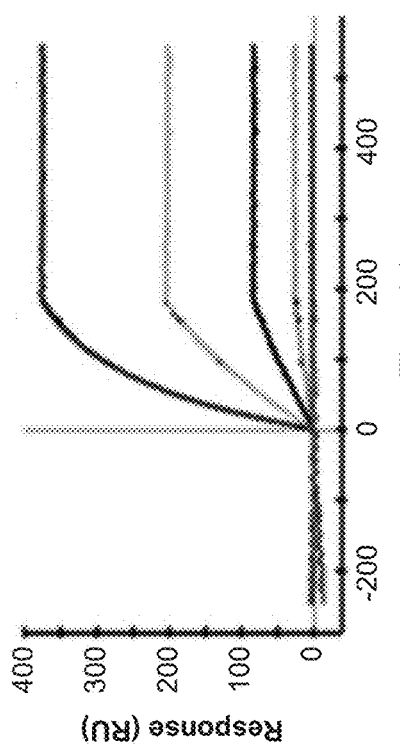
Figure 33G:
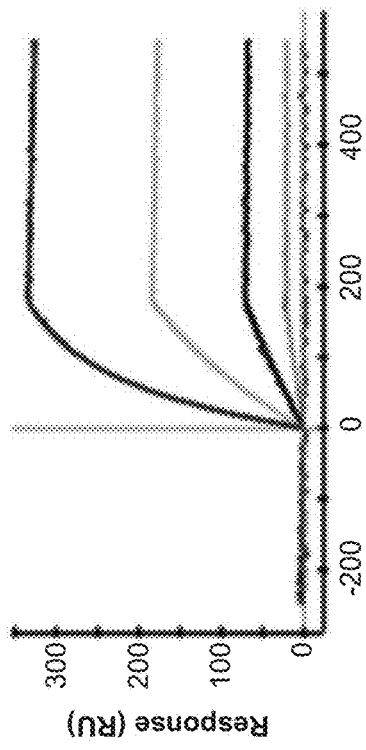
Figure 33H:
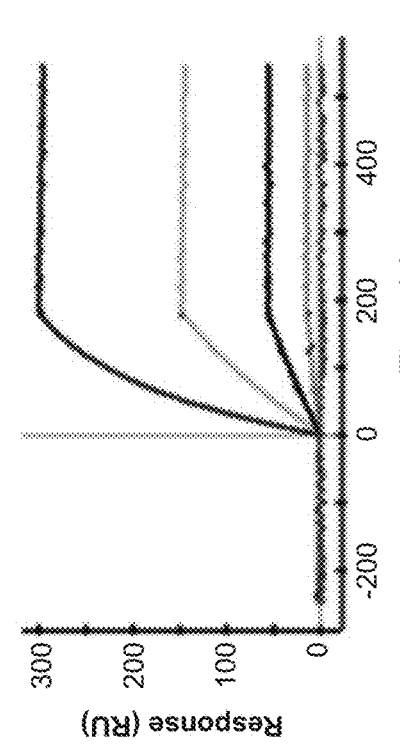

FIGS. 32A and 32B shows the alignment of the parental anti-CD19 clone 8B8 (SEQ ID NO:202; SEQ ID NO:201) with the selected affinity-matured binders. Shown are the sequences of clone 8B8 and all selected affinity-matured binders. CDRs of both heavy and light chains are framed (SEQ ID NOs:231-272)

FIGS. 33A to 33H relates to the SPR analysis of the parental 8B8 clone and its affinity-matured variants. Shown are the sensorgrams of clone 8B8 and its affinity-matured derivatives that are devoid of the LCDR1 N27d and N28 hotspots.

Figure 34:
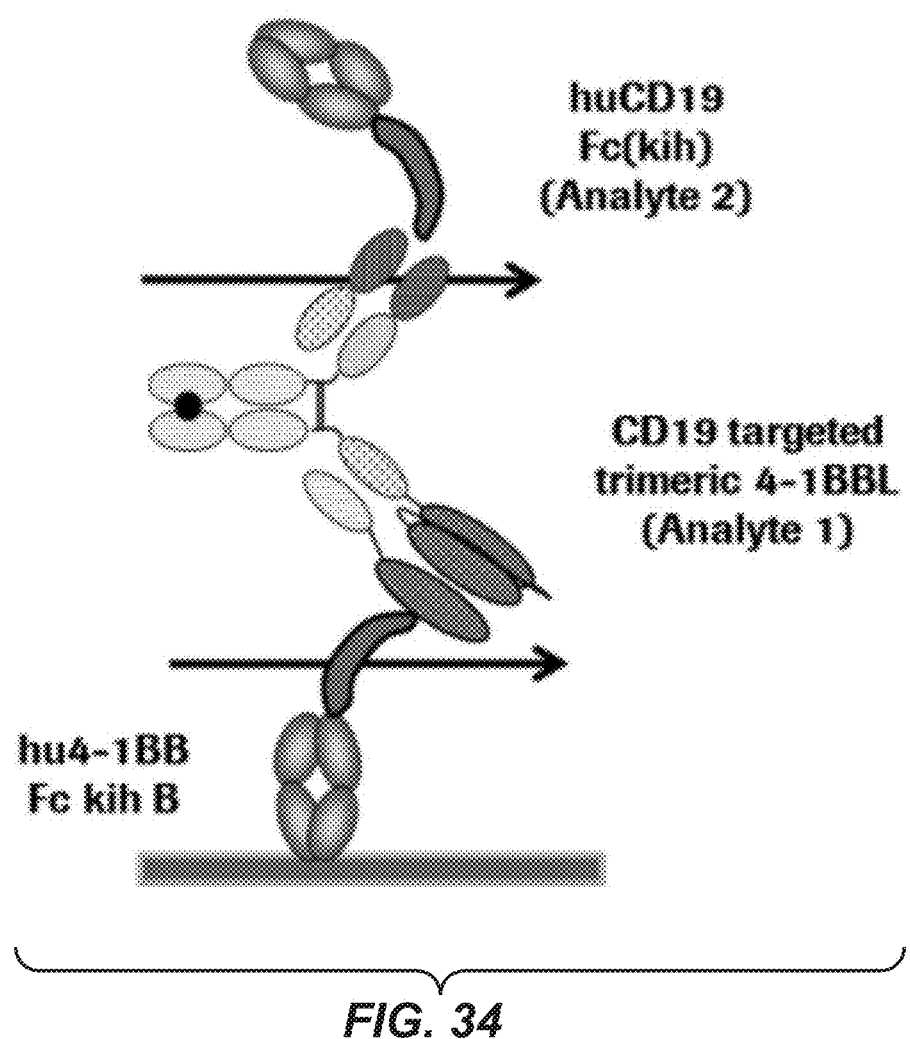
Figure 35A:
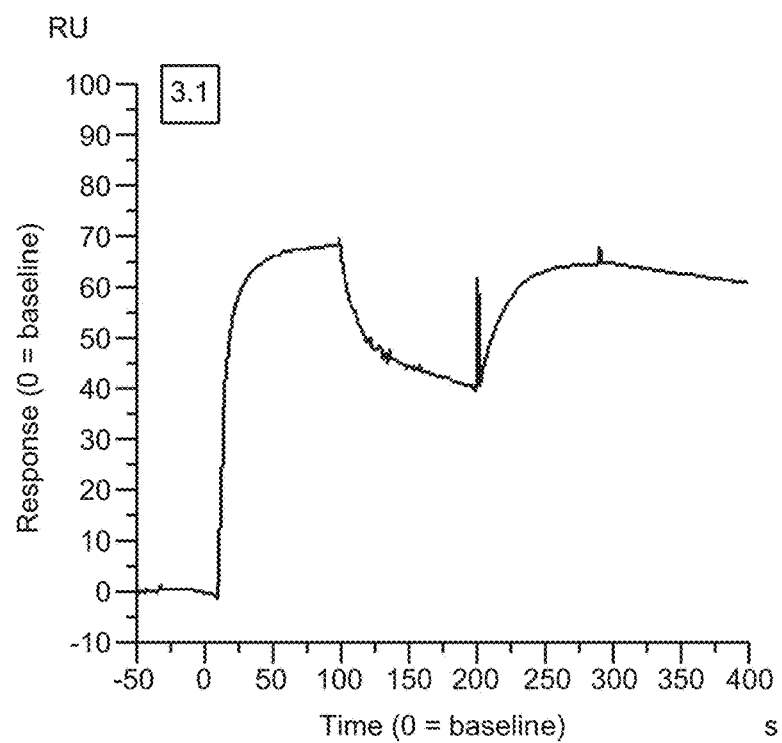
Figure 35B:
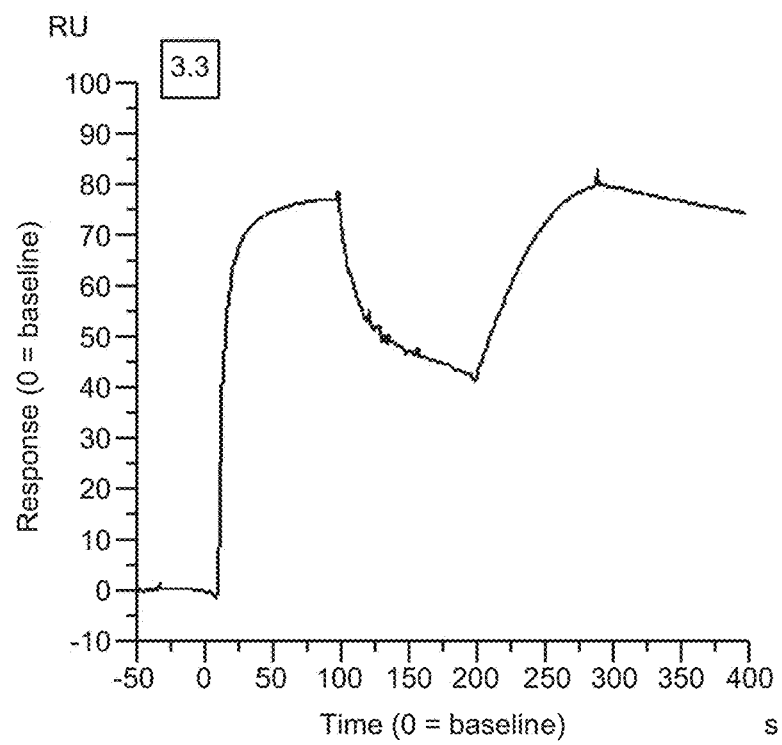
Figure 35C:
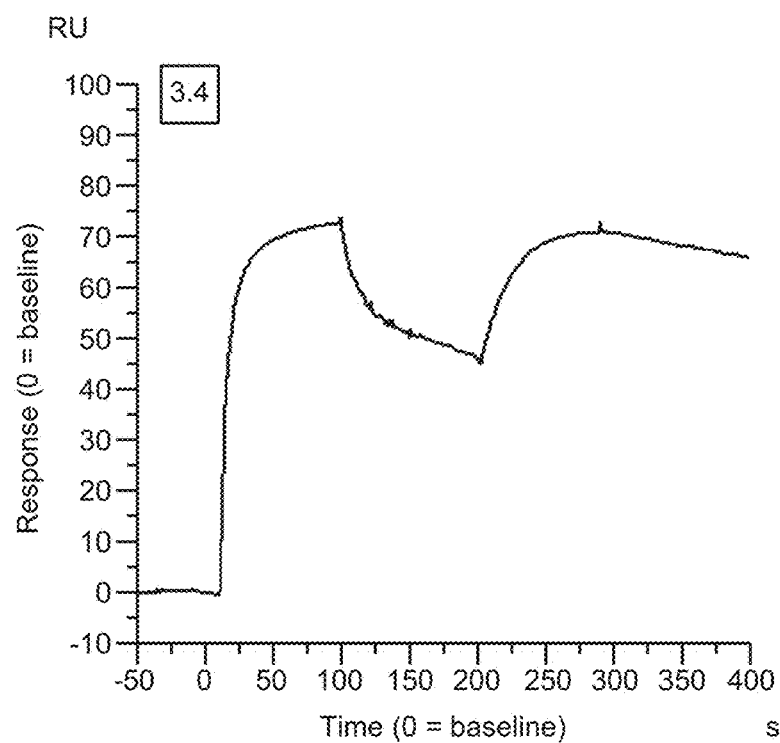
Figure 35D:
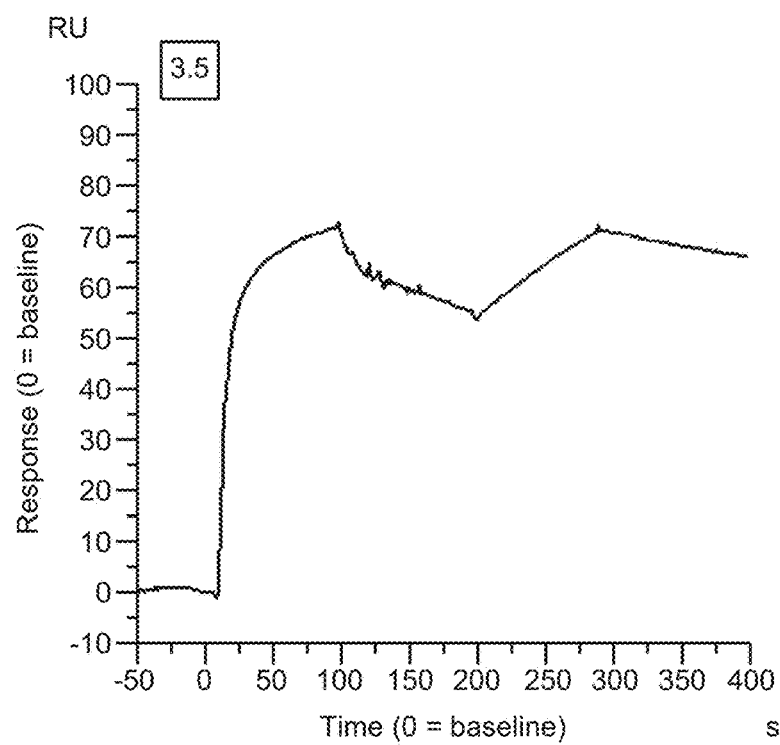
Figure 35E:
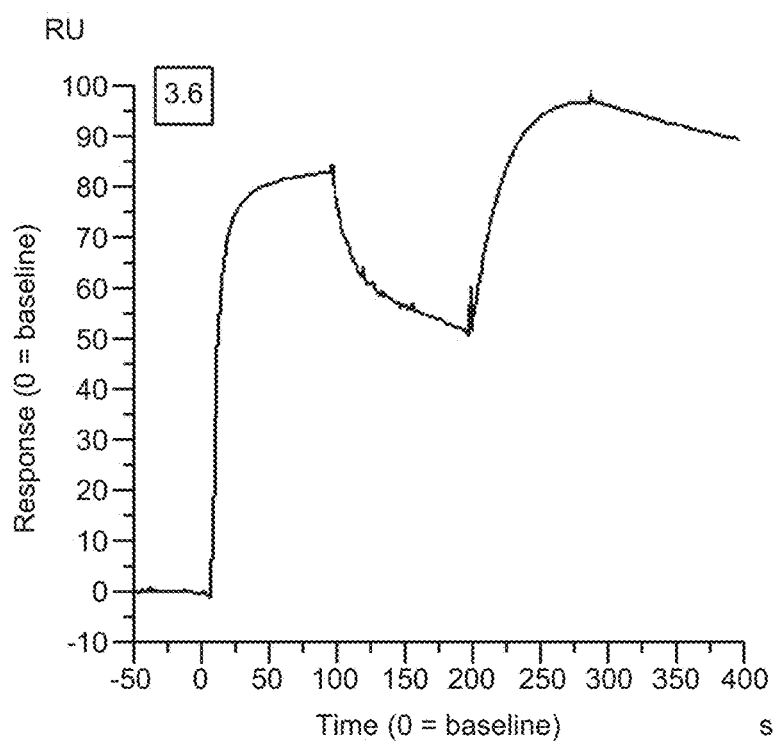
Figure 35F:
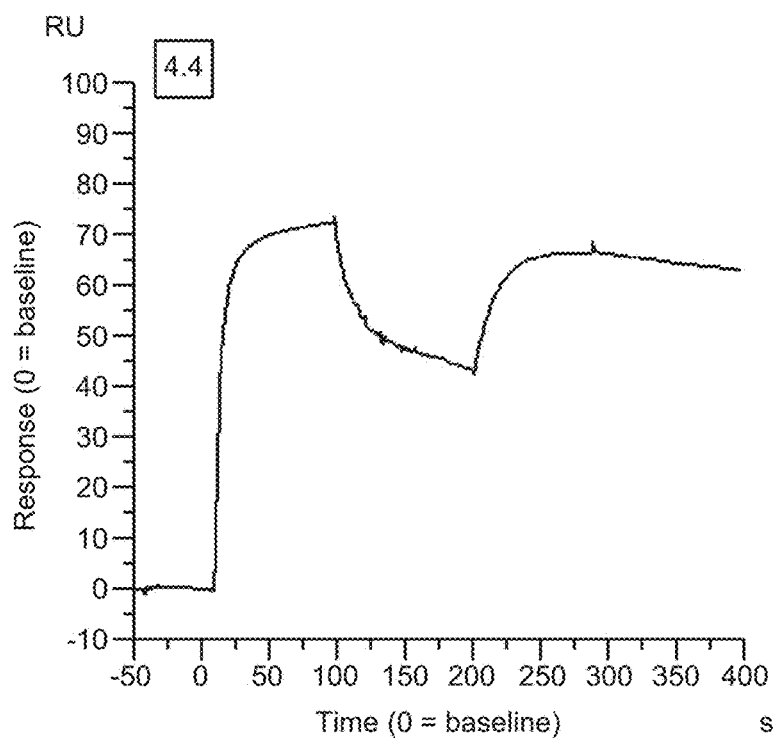

FIG. 34 illustrates the setup of the assay measuring Simultaneous binding of CD19 targeted trimeric split 4-1BBL to hu4-1BB and huCD19 (Example 8.2).

FIGS. 35A-35F show simultaneous binding of the CD19 targeted trimeric 4-1BBL FC fusion antigen binding molecules Constructs 3.1, 3.3, 3.4, 3.5, 3.6 and 4.4 (Analyte 1) to immobilized human 4-1BB and human CD19 (Analyte 2).

Figures 3, 7B:
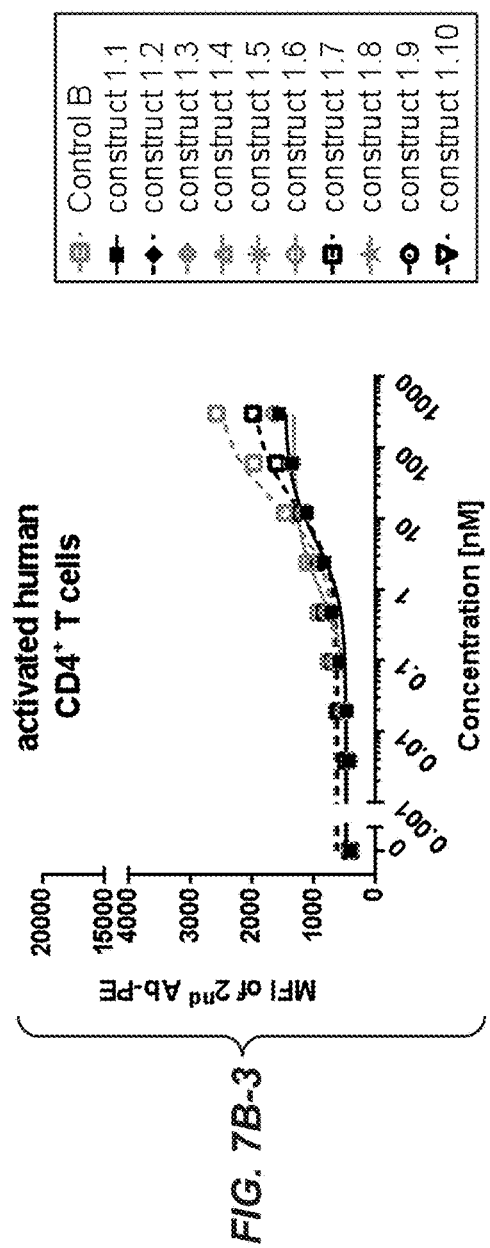
Figures 2, 36A:
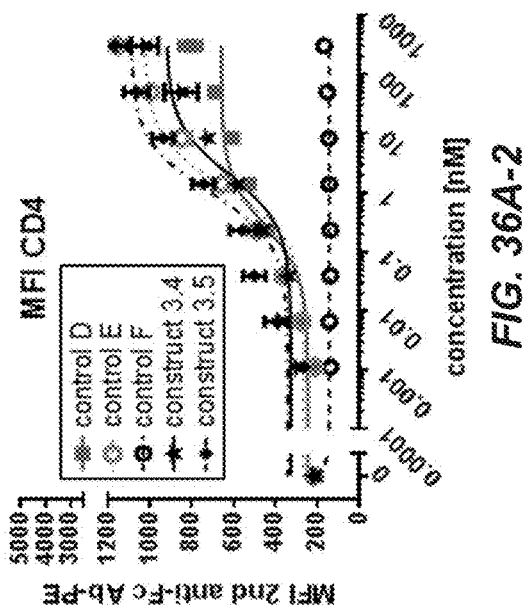
Figures 1, 36A:
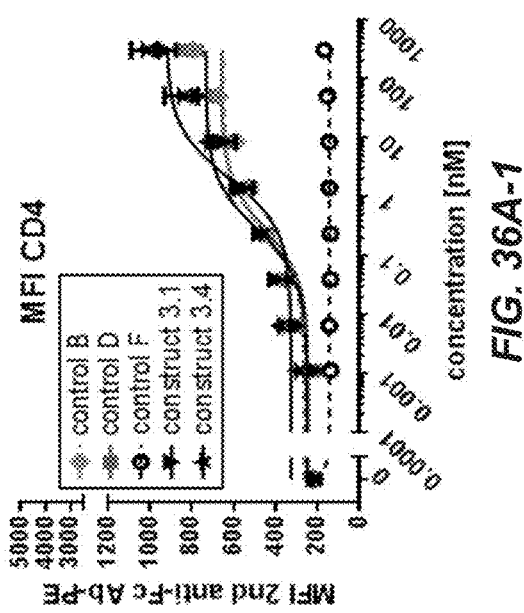
Figures 3, 36A:
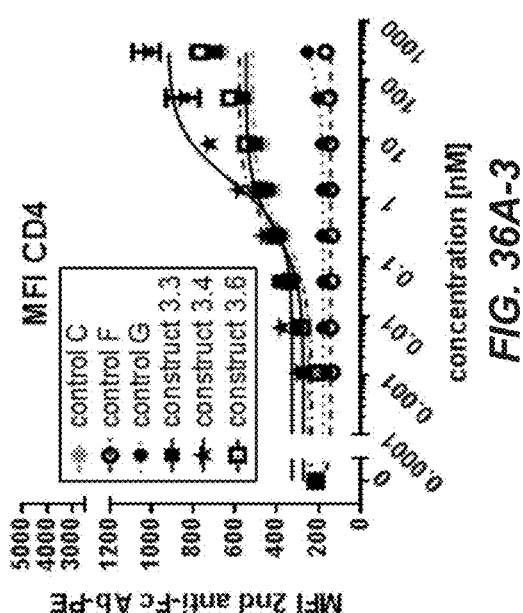
Figures 1, 36B:
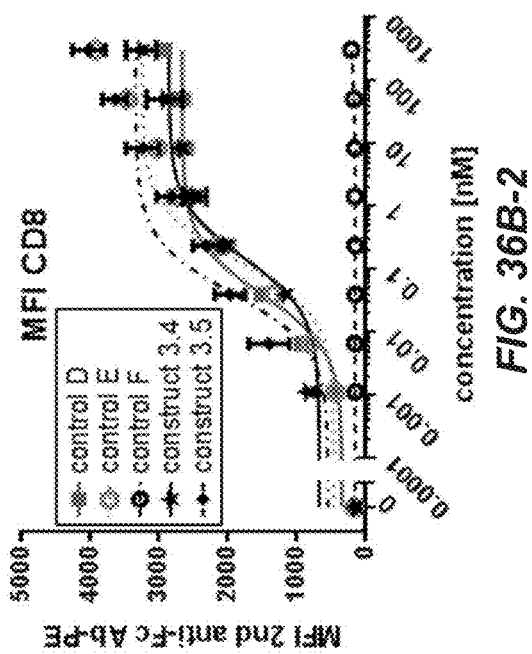
Figures 2, 36B:
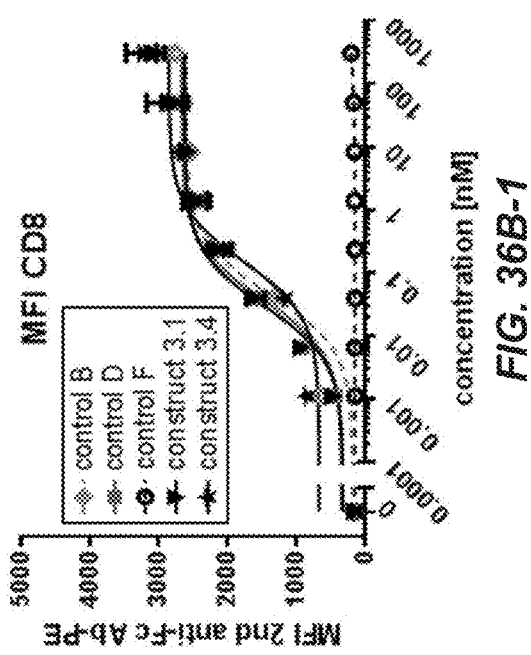
Figures 3, 36B:
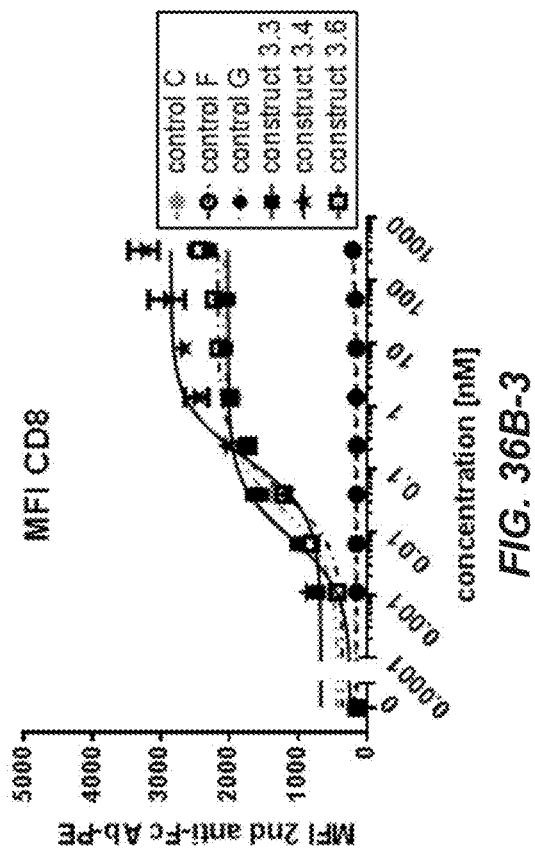

FIGS. 36A-1 to 36B-3 shows the binding of different CD19-targeted or untargeted split trimeric human 4-1BB ligand Fc (kih) constructs to 4-1BB-expressing CD4 and CD8 T cells of PHA-L and Proleukin pre-activated and anti-human CD3/anti-human CD28 re-activated human PBMCs. Binding was detected with R-Phycoerythrin-fluorochrome conjugated anti-human IgG Fcγ-specific goat IgG F(ab')2 fragment. Shown is the median of fluorescence intensity (MFI) versus the concentration of tested constructs. For a better display the binding curves are split in three different blots with construct 3.4 and control F (Isotype control huIgG1 P329G LALA) as comparison curves. Binding was monitored on CD45+ CD3+ CD8+ T cells (FIG. 36A-1 to 36A-3) and CD45+ CD3+ CD4+ T cells (FIG. 36B-1 to 36B-3). The 4-1BB expression level on CD8 T cells is normally higher than on CD4 T cells. All constructs bind with a quite similar affinity to human 4-1BB.

FIGS. 37A-1 to 37D-3 shows the binding of CD19-targeted or untargeted split trimeric human 4-1BB ligand Fc (kih) antigen binding molecules to human-CD19 expressing B cell lymphoma cell lines: diffuse large non-Hodgkin B cell lymphoma SU-DHL-8 (37A-1 to 37A-3), acute B cell precursor lymphoid leukemia Nalm6 (37B-1 to 37B-3), diffuse large cell lymphoblast lymphoma Toledo (37C-1 to 37C-3) and diffuse large B cell lymphoma OCI-Ly18 (37D-1 to 37D-3). Binding was detected with R-Phycoerythrin-fluorochrome conjugated anti-human IgG Fcγ-specific goat IgG F(ab')2 fragments. Shown is the median of fluorescence intensity (MFI) versus the concentration of tested constructs. For a better display the binding curves are split in three different blots with construct 3.4 and control F (Isotype control huIgG1 P329G LALA) as comparison curves. All constructs bind with a quite similar affinity to human CD19.

FIGS. 38A to 38C relates to NFκB-activation-induced Luciferase expression and activity of CD19-targeted or untargeted split trimeric human 4-1BB ligand Fc (kih) antigen binding molecules. Units of released light (URL) are measured for 0.5 s/well and plotted against the used concentration of CD19-targeted or untargeted split trimeric human 4-1BB ligand Fc (kih) constructs 3.1 and 3.3 and control molecules B and C. Human 4-1BB-expressing HeLa-reporter cells were incubated for 7.5 h in the absence presence of crosslinking human-CD19 expressing SU-DHL-8 or Pfeiffer cells. URLs were measured and blotted against the concentrations of different CD19-targeted or untargeted split trimeric human 4-1BB ligand Fc (kih) constructs. The cell ratio is one 4-1BB-expressing HeLa reporter cell to 2.5 or five tumor cells.

Figure 39:
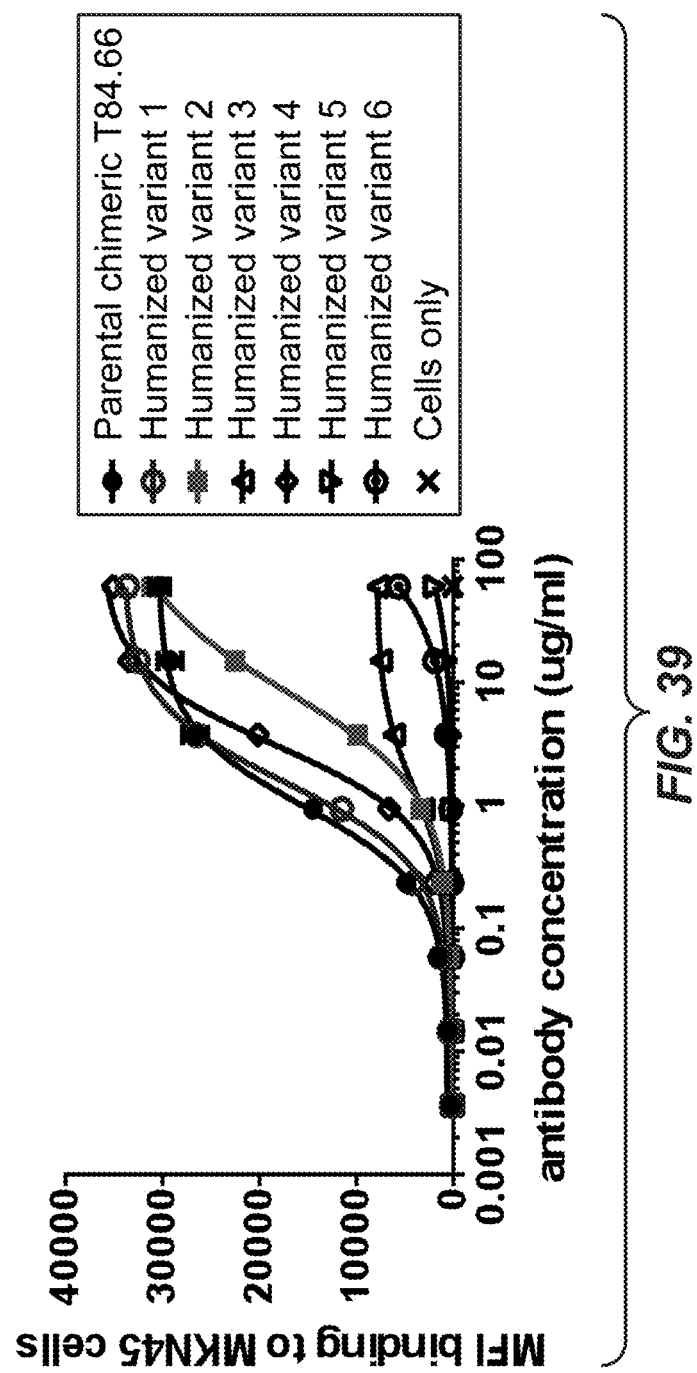

FIG. 39 shows the binding of different humanized variants of T84.66 IgG on CEA-expressing human gastric adenocarcinoma cells. Based on the data humanized variant 1 was selected for including it into CEA-targeted trimeric human 4-1BB ligand Fc (kih) antigen binding molecules.

FIGS. 40A to 40F shows the CEA targeted 4-1BBL-trimer-containing antigen binding molecules Constructs 5.1 to 5.6 of the invention. The preparation and production of these constructs is described in Example 11. The VH and VL domains are those of anti-CEA antibody T84.66-LCHA, the thick black point stands for the knob-into-hole modification. * symbolizes amino acid modifications in the CH1 and CL domain (so-called charged residues).

Figure 41A:
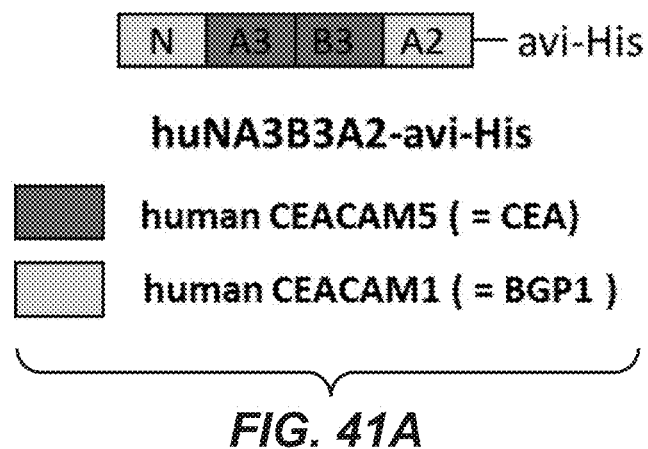

FIG. 41A shows a schematic description of human NA3B3A2-avi His, the antigen used to assess binding of CEA-targeted trimeric split 4-1BBL Fc (kih) antigen binding molecules.

Figure 41B:
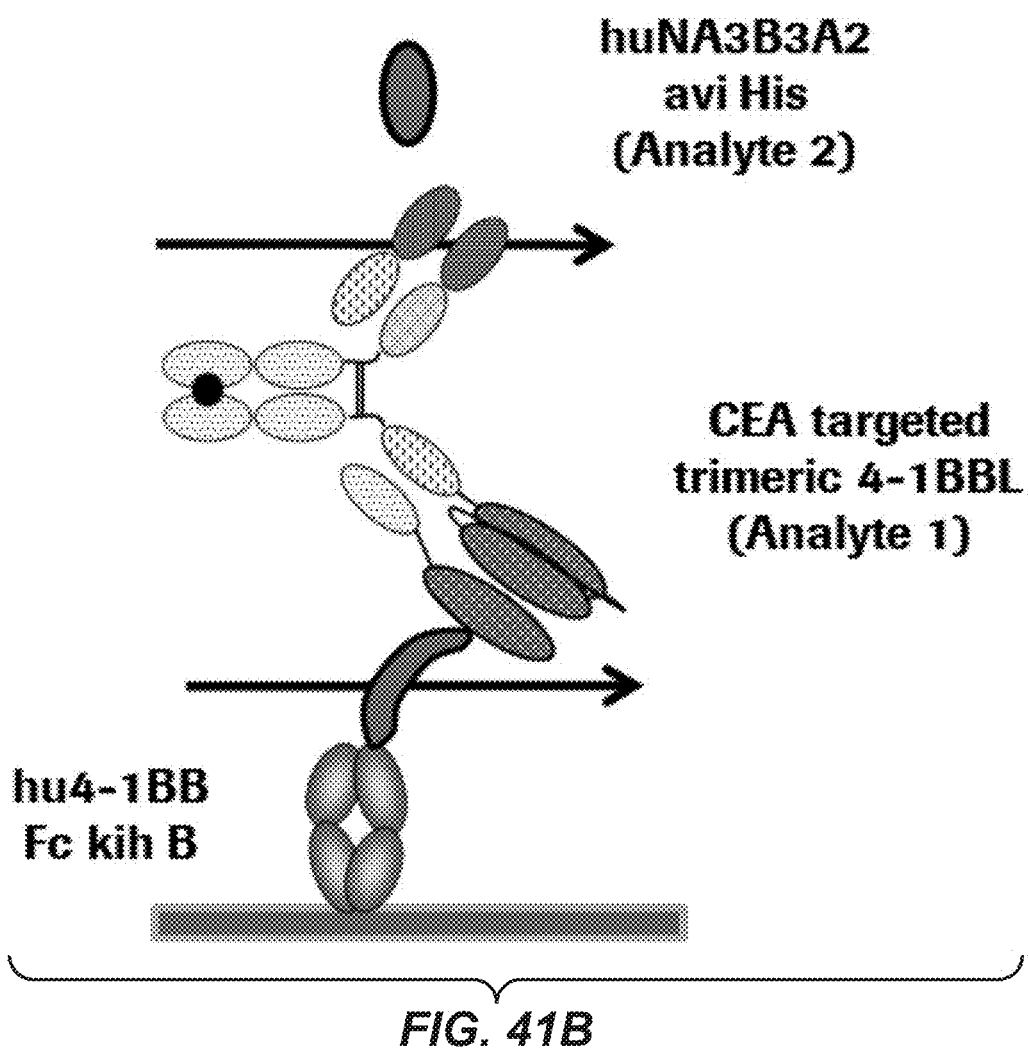
Figure 42A:
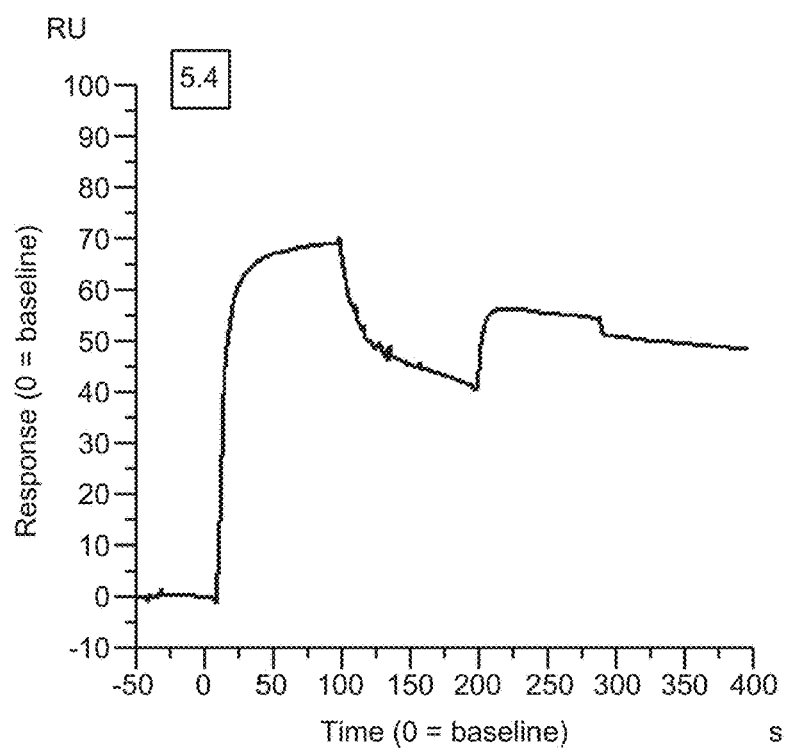
Figure 42B:
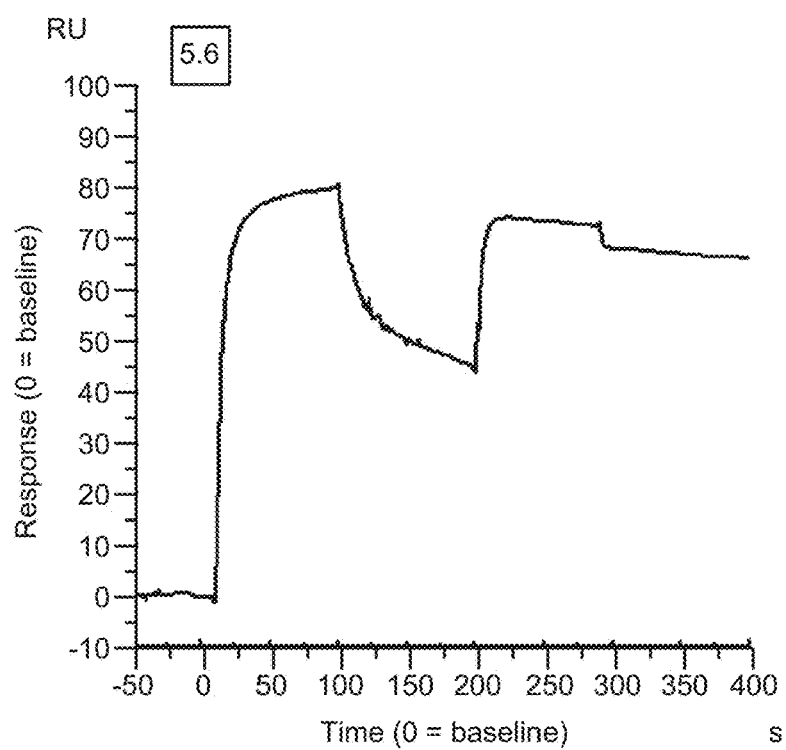
Figure 42C:
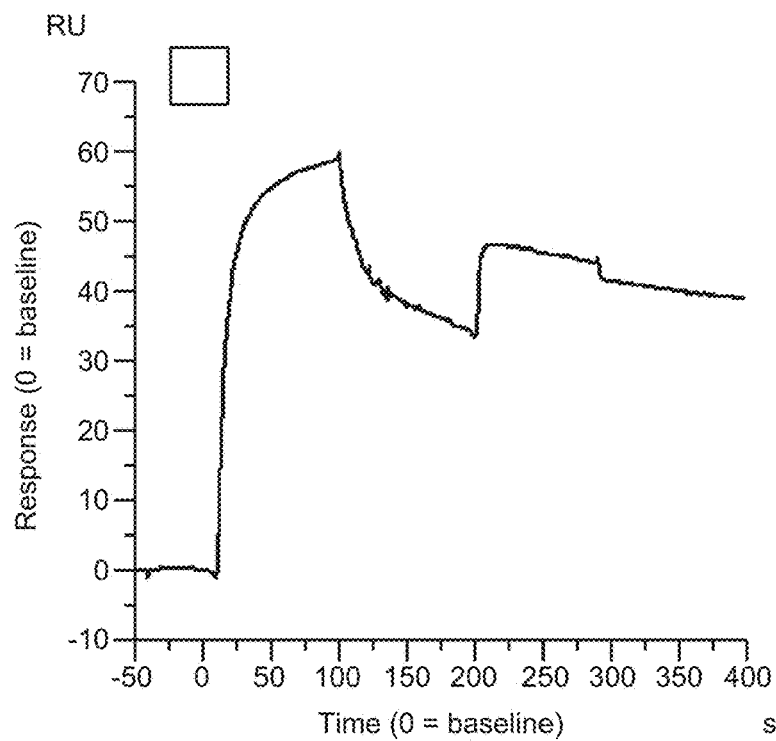
Figure 42D:
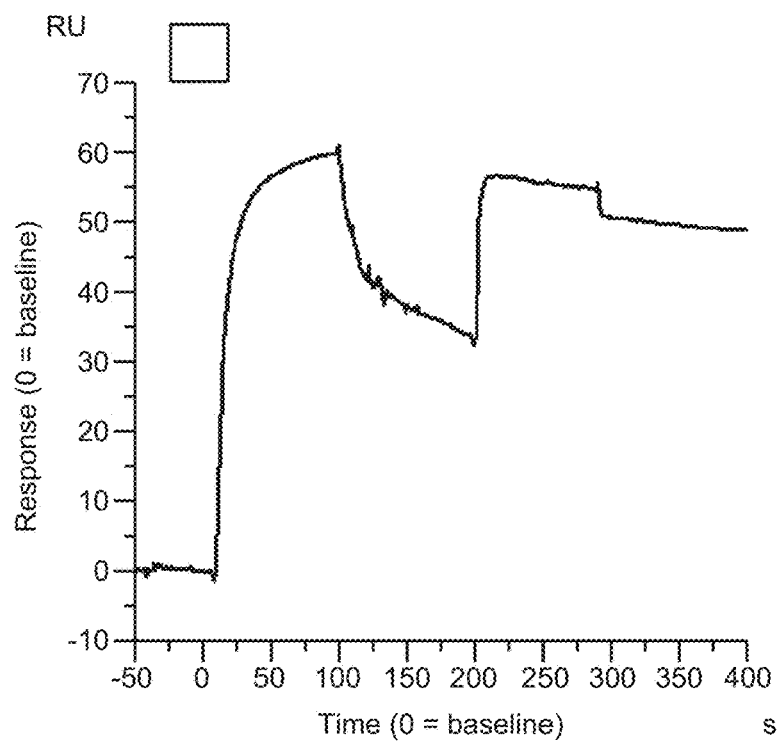

FIG. 41B illustrates the setup of the assay measuring simultaneous binding of CEA-targeted trimeric split 4-1BBL to hu4-1BB and human NA3B3A2 (Example 12.1).

FIGS. 42A to 42D show simultaneous binding of the CEA targeted trimeric 4-1BBL Fc fusion antigen binding molecules Constructs 5.4, 5.6, 5.7 and 5.8 (Analyte 1) to immobilized human 4-1BB and human NA3B3A2 (Analyte 2).

FIGS. 43A-43D show binding of different CEA-targeted or untargeted split trimeric human 4-1BB ligand Fc (kih) constructs to 4-1BB-expressing CD4 and CD8 T cells of PHA-L and Proleukin pre-activated and anti-human CD3/anti-human CD28 re-activated human PBMCs. Binding was detected with R-Phycoerythrin-fluorochrome conjugated anti-human IgG Fcγ-specific goat IgG F(ab')2 fragment. Shown is the median of fluorescence intensity (MFI) versus the concentration of tested constructs. For a better display the binding curves are split in two different blots with construct 5.4 and control F (Isotype control huIgG1 P329G LALA) as comparison curves. Binding was monitored on CD45+ CD3+ CD8+ T cells (blots on the bottom) and CD45+ CD3+ CD4+ T cells (blots on the top). The 4-1BB expression level on CD8 T cells is normally higher than on CD4 T cells. All constructs bind with quite similar affinity to human 4-1BB.

Figure 44B:
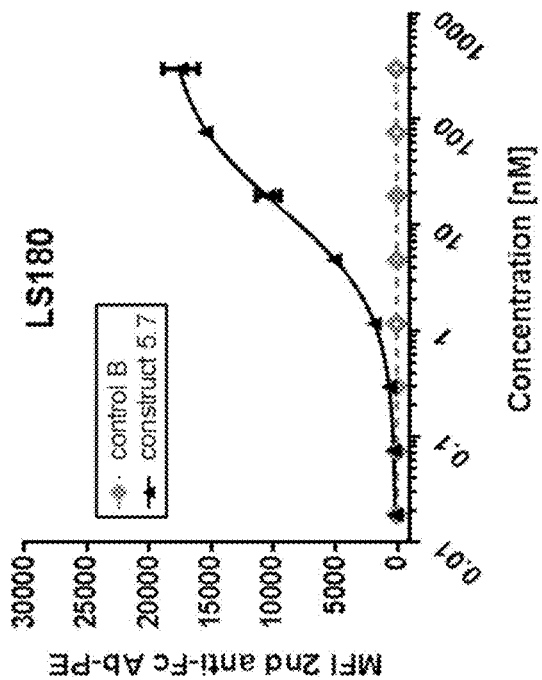
Figure 44A:
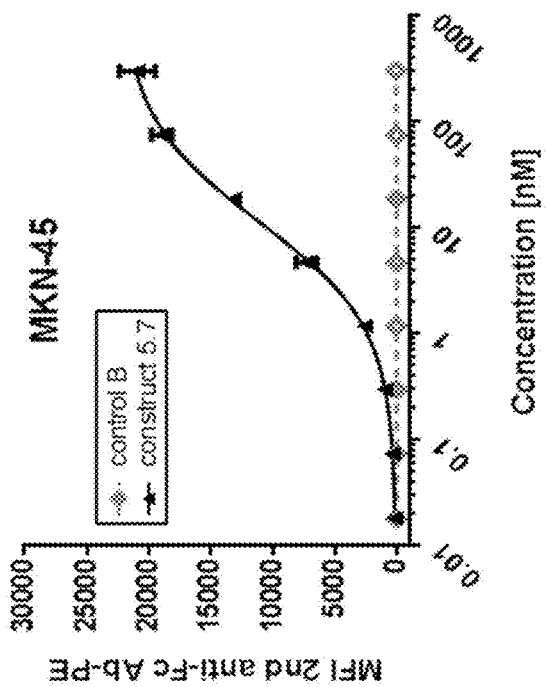
Figures 45A, 45B, 45C, 45D:
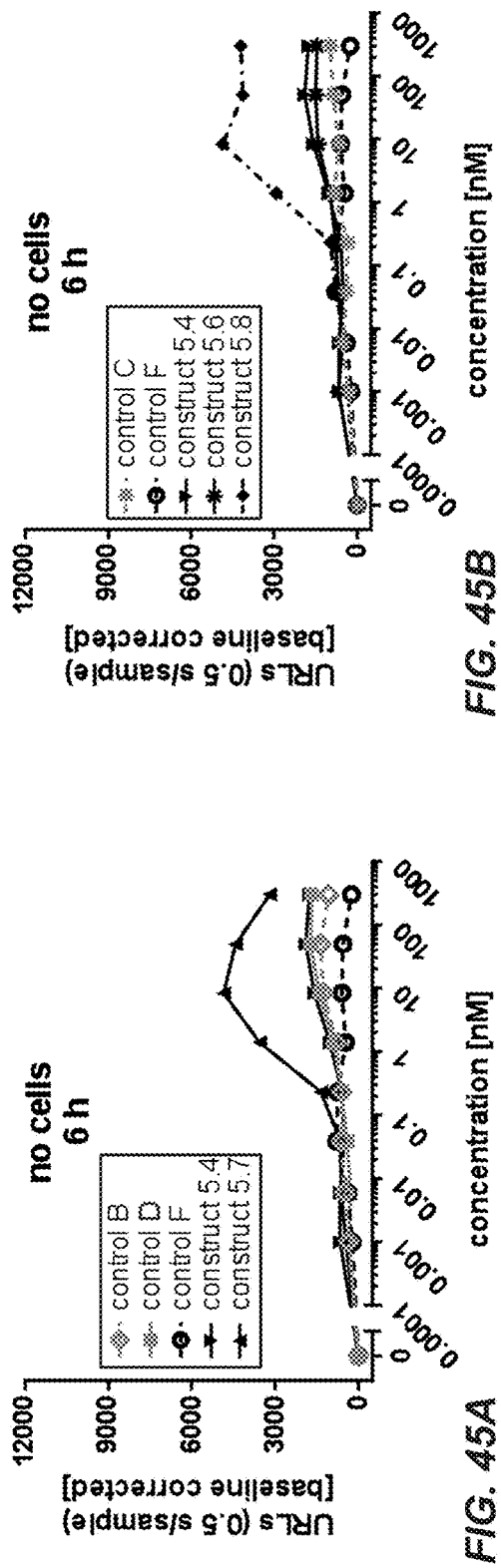

FIGS. 44A and 44B show the binding of CEA-targeted or untargeted split trimeric human 4-1BB ligand Fc (kih) constructs to human-CEA expressing human gastric cell line MKN-45 (44A) and human colorectal adenocarcinoma cells line LS180 (right 44B). Binding was detected with R-Phycoerythrin-fluorochrome conjugated anti-human IgG Fcγ-specific goat IgG F(ab') 2 fragments. Shown is the median of fluorescence intensity (MFI) versus the concentration of tested constructs.

FIGS. 45A to 45D relate to NFκB-activation-induced Luciferase expression and activity of CEA-targeted or untargeted split trimeric human 4-1BB ligand Fc (kih) antigen binding molecules. Units of released light (URL) are measured for 0.5 s/well and blotted against the used concentration of CEA-targeted or untargeted split trimeric human 4-1BB ligand Fc (kih) constructs 5.4, 5.6, 5.7 and 5.8 and control molecules. Human 4-1BB-expressing HeLa-reporter cells were incubated for 6 h in the absence or presence of crosslinking human-CEA expressing human gastric cancer cell line MKN-45. The cell ratio is one 4-1BB-expressing HeLa reporter cell to three tumor cells.

FIGS. 46A and 46B show the components for the assembly of monovalent FAP targeted split trimeric human OX40 ligand (construct 6.1) including linker GGGGSGGGGS (SEQ ID NO:13). FIG. 46A relates to dimeric ligand fused to human IgG1-CL domain, FIG. 46B relates to monomeric ligand fused to human IgG1-CH1 domain. FIG. 46C shows the FAP targeted OX40L-trimer-containing antigen binding molecule Construct 6.1. In FIG. 46D is shown the DP47 "untargeted" human IgG1 PGLALA (control F).

Figure 47A:
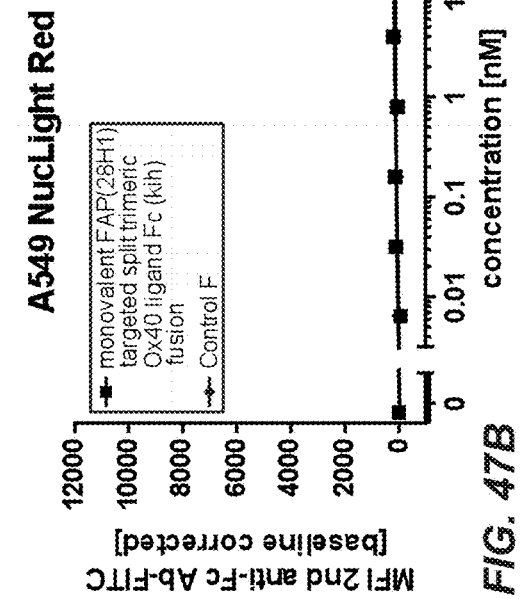
Figure 47B:
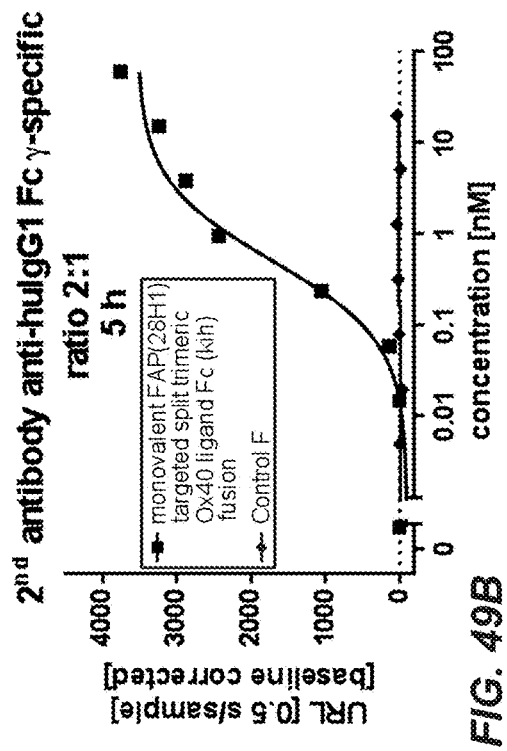

FIG. 47A shows the binding of FAP targeted split trimeric human OX40L to FAP positive WM-266-4 cells. WM-266-4 cells express high levels of human fibroblast activation protein (huFAP). Only FAP targeted OX40 ligand Fc (kih) constructs (filled square) but not control F (filled diamond) bound to WM-266-4 cells. Shown is the binding as median of fluorescence intensity (MFI) of Fluorescein isothiocyanate (FITC)-labeled anti-human IgG Fcγ-specific goat IgG F(ab')2 fragment which is used as secondary detection antibody. MFI was measured by flow cytometry. The x-axis shows the concentration of antibody constructs. FIG. 47B shows the binding of FAP targeted OX40 ligand Fc (kih) construct to human FAP human OX40 negative A549 NucLight™ Red cells. FAP targeted OX40 ligand Fc (kih) construct showed no binding to OX40 negative FAP negative A549 tumor cells. Shown is the binding as median of fluorescence intensity (MFI) of FITC labeled anti-human IgG Fcγ-specific goat IgG F(ab')2 fragment which is used as secondary detection antibody. MFI was measured by flow cytometry and baseline corrected by subtracting the MFI of the blank control.

Figure 48A:
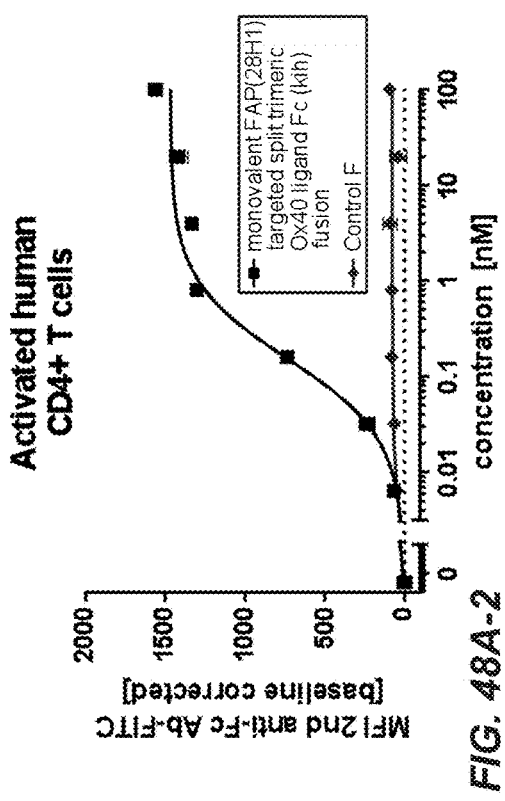
Figure 1:
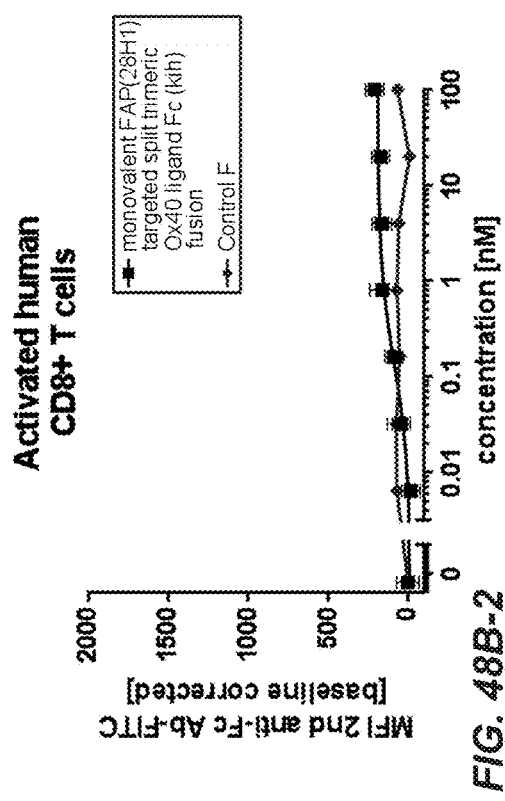
Figure 2:
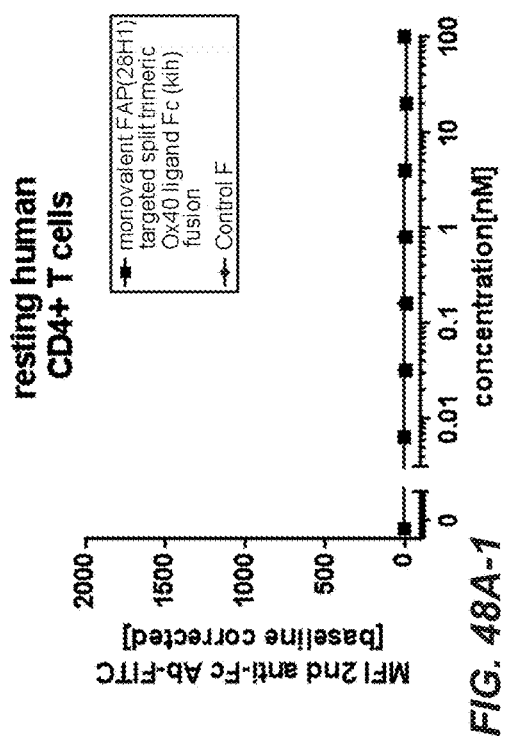
Figure 48B:
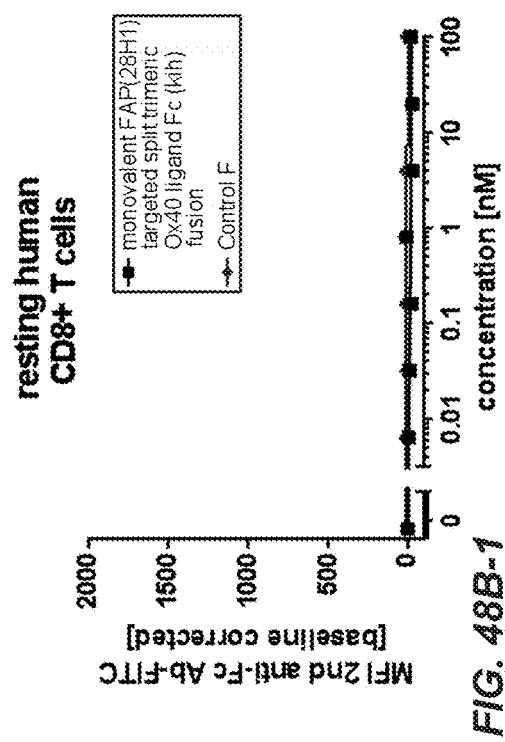

FIG. 48A-1 to 48A-2 show the binding of FAP-OX40L to resting and activated human CD4 T cells. OX40 is not expressed on resting human CD4 T cells (left side). In the absence of human OX40 expressing cells no binding was observed (48A-1). After activation of human PBMCs OX40 is up-regulated on CD4+ T cells (48A-2). FAP-OX40L bound to OX40+ activated CD4 T cells. Shown is the binding as median of fluorescence intensity (MFI) of FITC labeled anti-human IgG Fcγ-specific goat IgG F(ab')2 fragment which is used as secondary detection antibody. MFI was measured by flow cytometry and baseline corrected by subtracting the MFI of the blank control. The x-axis shows the concentration of antibody constructs. FIGS. 48B-1 and 48B-2 show that OX40 is not expressed on resting human CD8 T cells (left side). In the absence of human OX40 expressing cells no binding was observed (left graphs). After activation of human PBMCs OX40 is up-regulated on CD8+ T cells (right side). OX40 expression on human CD8+ T cells is lower than on CD4+ T cells and varies between donors and time points. Expression of OX40 was low on the depicted CD8 T cells. FAP-OX40L bound to OX40+ activated CD8 T cells. Shown is the binding as median of fluorescence intensity (MFI) of FITC labeled anti-human IgG Fcγ-specific goat IgG F(ab')2 fragment which is used as secondary detection antibody. MFI was measured by flow cytometry and baseline corrected by subtracting the MFI of the blank control. The x-axis shows the concentration of antibody constructs FIGS. 49A and 49B the activation of NFκB signaling pathway by the FAP targeted split trimeric human OX40L antigen binding molecule (FAP-OX40L) in HeLa_hOx40_NFkB_Luc1 reporter cells is demonstrated. Shown is the activation with (49B) or without (49A) crosslinking by secondary antibody. The reporter cells were cultured for 5 hours in the presence of FAP-OX40L at the indicated concentrations with or without crosslinking secondary poly-clonal anti-huIgG1 Fcγ-specific goat IgG F(ab)2 fragment in a 1:2 ratio. Luciferase activity was assessed as described in Example 6.1. Activity is characterized by blotting the units of released light (URL) measured during 0.5 s versus the concentration in nM of tested construct. URLs are emitted due to luciferase-mediated oxidation of luciferin to oxyluciferin.

Figure 50B:
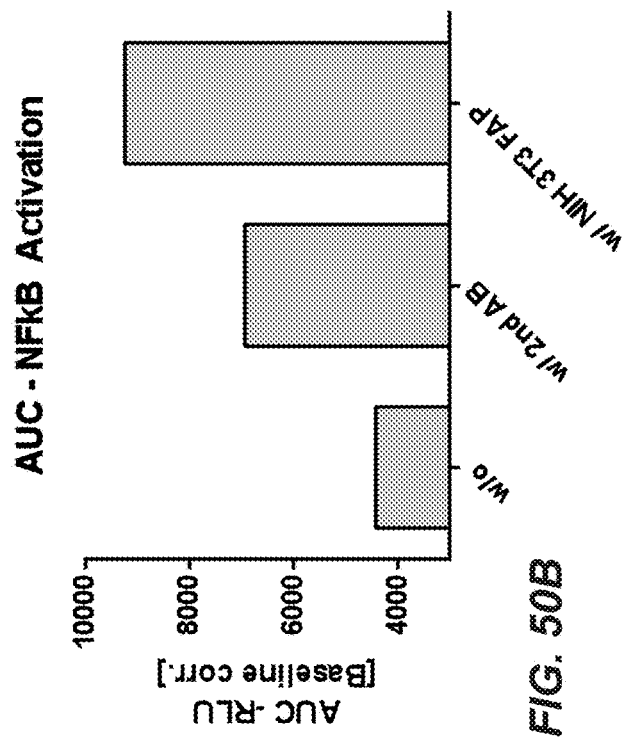
Figure 50A:
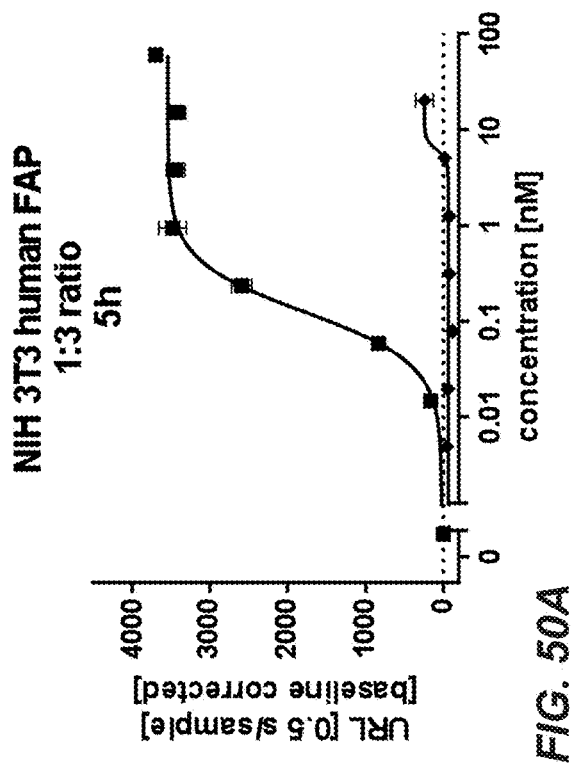

FIG. 50A shows the activation of NFκB by FAP-OX40L in HeLa_hOx40_NFkB_Luc1 reporter cells in the presence of FAP positive cells. Shown is the activation of NFκB signaling pathway in the reporter cells by FAP-OX40L in the presence of low FAP expressing expressing NIH-3T3 human FAP cells (ratio 3 FAP+ tumor cells to 1 reporter cell). The NFκB-mediated luciferase activity was characterized by blotting the units of released light (URL), measured during 0.5 s, versus the concentration in nM of tested compounds. URLs are emitted due to luciferase-mediated oxidation of luciferin to oxyluciferin. Values are baseline corrected by subtracting the URLs of the blank control. For a better comparison the area under the curve of the respective blotted dose-response curves were quantified as a marker for the agonistic capacity of each construct. The comparison is illustrated in FIG. 50B. The area was calculated using GraphPad Prism. Values are baseline corrected by subtracting the value of the blank control.

FIGS. 51A to 51D shows the OX40 mediated costimulation of suboptimally TCR triggered resting human PBMC (Example 15.5). Hyper-crosslinking of FAP-OX40L by the present NIH/3T3-huFAP clone 39 cells strongly promoted survival and proliferation in human CD4 and CD8 T cells. Shown is the event count of vital CD4+ (51A and 51C) and CD8+ (51B and 51D) T cells. Baseline values of samples containing only the anti-human CD3 (clone V9, huIgG1), resting human PBMC and NIH/3T3-huFAP clone 39 were subtracted. Thus the enhancing effect of OX40 co-stimulation but not the effect of suboptimal anti-CD3 stimulation per se is shown here. In the Figures on the bottom the rescue of suboptimal TCR stimulation of resting human PBMC with cell surface immobilized FAP-OX40L—Proliferation is shown.

DETAILED DESCRIPTION OF THE INVENTION

Definitions

Unless defined otherwise, technical and scientific terms used herein have the same meaning as generally used in the art to which this invention belongs. For purposes of interpreting this specification, the following definitions will apply and whenever appropriate, terms used in the singular will also include the plural and vice versa.

As used herein, the term "antigen binding molecule" refers in its broadest sense to a molecule that specifically binds an antigenic determinant. Examples of antigen binding molecules are antibodies, antibody fragments and scaffold antigen binding proteins.

As used herein, the term "moiety capable of specific binding to a target cell antigen" refers to a polypeptide molecule that specifically binds to an antigenic determinant. In one aspect, the antigen binding moiety is able to activate signaling through its target cell antigen. In a particular aspect, the antigen binding moiety is able to direct the entity to which it is attached (e.g. the TNF family ligand trimer) to a target site, for example to a specific type of tumor cell or tumor stroma bearing the antigenic determinant. Moieties capable of specific binding to a target cell antigen include antibodies and fragments thereof as further defined herein. In addition, moieties capable of specific binding to a target cell antigen include scaffold antigen binding proteins as further defined herein, e.g. binding domains which are based on designed repeat proteins or designed repeat domains (see e.g. WO 2002/020565).

In relation to an antibody or fragment thereof, the term "moiety capable of specific binding to a target cell antigen" refers to the part of the molecule that comprises the area which specifically binds to and is complementary to part or all of an antigen. A moiety capable of specific antigen binding may be provided, for example, by one or more antibody variable domains (also called antibody variable regions). Particularly, a moiety capable of specific antigen binding comprises an antibody light chain variable region (VL) and an antibody heavy chain variable region (VH).

The term "antibody" herein is used in the broadest sense and encompasses various antibody structures, including but not limited to monoclonal antibodies, polyclonal antibodies, monospecific and multispecific antibodies (e.g., bispecific antibodies), and antibody fragments so long as they exhibit the desired antigen-binding activity.

The term "monoclonal antibody" as used herein refers to an antibody obtained from a population of substantially homogeneous antibodies, i.e., the individual antibodies comprising the population are identical and/or bind the same epitope, except for possible variant antibodies, e.g. containing naturally occurring mutations or arising during production of a monoclonal antibody preparation, such variants generally being present in minor amounts. In contrast to polyclonal antibody preparations, which typically include different antibodies directed against different determinants (epitopes), each monoclonal antibody of a monoclonal antibody preparation is directed against a single determinant on an antigen.

The term "monospecific" antibody as used herein denotes an antibody that has one or more binding sites each of which bind to the same epitope of the same antigen. The term "bispecific" means that the antigen binding molecule is able to specifically bind to at least two distinct antigenic determinants. Typically, a bispecific antigen binding molecule comprises two antigen binding sites, each of which is specific for a different antigenic determinant. In certain embodiments the bispecific antigen binding molecule is capable of simultaneously binding two antigenic determinants, particularly two antigenic determinants expressed on two distinct cells.

The term "valent" as used within the current application denotes the presence of a specified number of binding sites in an antigen binding molecule. As such, the terms "bivalent", "tetravalent", and "hexavalent" denote the presence of two binding sites, four binding sites, and six binding sites, respectively, in an antigen binding molecule.

The terms "full length antibody", "intact antibody", and "whole antibody" are used herein interchangeably to refer to an antibody having a structure substantially similar to a native antibody structure. "Native antibodies" refer to naturally occurring immunoglobulin molecules with varying structures. For example, native IgG-class antibodies are heterotetrameric glycoproteins of about 150,000 daltons, composed of two light chains and two heavy chains that are disulfide-bonded. From N- to C-terminus, each heavy chain has a variable region (VH), also called a variable heavy domain or a heavy chain variable domain, followed by three constant domains (CH1, CH2, and CH3), also called a heavy chain constant region. Similarly, from N- to C-terminus, each light chain has a variable region (VL), also called a variable light domain or a light chain variable domain, followed by a light chain constant domain (CL), also called a light chain constant region. The heavy chain of an antibody may be assigned to one of five types, called α (IgA), δ (IgD), ε (IgE), γ (IgG), or μ (IgM), some of which may be further divided into subtypes, e.g. γ1 (IgG1), γ2 (IgG2), γ3 (IgG3), γ4 (IgG4), α1 (IgA1) and α2 (IgA2). The light chain of an antibody may be assigned to one of two types, called kappa (κ) and lambda (λ), based on the amino acid sequence of its constant domain.

An "antibody fragment" refers to a molecule other than an intact antibody that comprises a portion of an intact antibody that binds the antigen to which the intact antibody binds. Examples of antibody fragments include but are not limited to Fv, Fab, Fab', Fab'-SH, F(ab')$_2$; diabodies, triabodies, tetrabodies, cross-Fab fragments; linear antibodies; single-chain antibody molecules (e.g. scFv); and single domain antibodies. For a review of certain antibody fragments, see Hudson et al., Nat Med 9, 129-134 (2003). For a review of scFv fragments, see e.g. Plückthun, in The Pharmacology of Monoclonal Antibodies, vol. 113, Rosenburg and Moore eds., Springer-Verlag, New York, pp. 269-315 (1994); see also WO 93/16185; and U.S. Pat. Nos. 5,571,894 and 5,587,458. For discussion of Fab and F(ab')2 fragments comprising salvage receptor binding epitope residues and having increased in vivo half-life, see U.S. Pat. No. 5,869, 046. Diabodies are antibody fragments with two antigen-binding sites that may be bivalent or bispecific, see, for example, EP 404,097; WO 1993/01161; Hudson et al., Nat Med 9, 129-134 (2003); and Hollinger et al., Proc Natl Acad Sci USA 90, 6444-6448 (1993). Triabodies and tetrabodies are also described in Hudson et al., Nat Med 9, 129-134 (2003). Single-domain antibodies are antibody fragments comprising all or a portion of the heavy chain variable domain or all or a portion of the light chain variable domain of an antibody. In certain embodiments, a single-domain antibody is a human single-domain antibody (Domantis, Inc., Waltham, Mass.; see e.g. U.S. Pat. No. 6,248,516 B1). Antibody fragments can be made by various techniques, including but not limited to proteolytic digestion of an intact antibody as well as production by recombinant host cells (e.g. *E. coli* or phage), as described herein.

Papain digestion of intact antibodies produces two identical antigen-binding fragments, called "Fab" fragments containing each the heavy- and light-chain variable domains and also the constant domain of the light chain and the first constant domain (CH1) of the heavy chain. As used herein, Thus, the term "Fab fragment" refers to an antibody fragment comprising a light chain fragment comprising a VL domain and a constant domain of a light chain (CL), and a VH domain and a first constant domain (CH1) of a heavy chain. Fab' fragments differ from Fab fragments by the addition of a few residues at the carboxy terminus of the heavy chain CH1 domain including one or more cysteins from the antibody hinge region. Fab'-SH are Fab' fragments in which the cysteine residue(s) of the constant domains bear a free thiol group. Pepsin treatment yields an F(ab')$_2$ fragment that has two antigen-combining sites (two Fab fragments) and a part of the Fc region.

The term "cross-Fab fragment" or "xFab fragment" or "crossover Fab fragment" refers to a Fab fragment, wherein either the variable regions or the constant regions of the heavy and light chain are exchanged. Two different chain compositions of a crossover Fab molecule are possible and comprised in the bispecific antibodies of the invention: On the one hand, the variable regions of the Fab heavy and light chain are exchanged, i.e. the crossover Fab molecule comprises a peptide chain composed of the light chain variable region (VL) and the heavy chain constant region (CH1), and a peptide chain composed of the heavy chain variable region (VH) and the light chain constant region (CL). This crossover Fab molecule is also referred to as CrossFab$_{(VLVH)}$. On the other hand, when the constant regions of the Fab heavy and light chain are exchanged, the crossover Fab molecule comprises a peptide chain composed of the heavy chain variable region (VH) and the light chain constant region (CL), and a peptide chain composed of the light chain variable region (VL) and the heavy chain constant region (CH1). This crossover Fab molecule is also referred to as CrossFab$_{(CLCH1)}$.

A "single chain Fab fragment" or "scFab" is a polypeptide consisting of an antibody heavy chain variable domain (VH), an antibody constant domain 1 (CH1), an antibody light chain variable domain (VL), an antibody light chain constant domain (CL) and a linker, wherein said antibody domains and said linker have one of the following orders in N-terminal to C-terminal direction: a) VH-CH1-linker-VL-CL, b) VL-CL-linker-VH-CH1, c) VH-CL-linker-VL-CH1 or d) VL-CH1-linker-VH-CL; and wherein said linker is a polypeptide of at least 30 amino acids, preferably between 32 and 50 amino acids. Said single chain Fab fragments are stabilized via the natural disulfide bond between the CL domain and the CH1 domain. In addition, these single chain Fab molecules might be further stabilized by generation of interchain disulfide bonds via insertion of cysteine residues (e.g. position 44 in the variable heavy chain and position 100 in the variable light chain according to Kabat numbering).

A "crossover single chain Fab fragment" or "x-scFab" is a is a polypeptide consisting of an antibody heavy chain variable domain (VH), an antibody constant domain 1 (CH1), an antibody light chain variable domain (VL), an antibody light chain constant domain (CL) and a linker, wherein said antibody domains and said linker have one of the following orders in N-terminal to C-terminal direction: a) VH-CL-linker-VL-CH1 and b) VL-CH1-linker-VH-CL; wherein VH and VL form together an antigen-binding site which binds specifically to an antigen and wherein said linker is a polypeptide of at least 30 amino acids. In addition, these x-scFab molecules might be further stabilized by generation of interchain disulfide bonds via insertion of cysteine residues (e.g. position 44 in the variable heavy chain and position 100 in the variable light chain according to Kabat numbering).

A "single-chain variable fragment (scFv)" is a fusion protein of the variable regions of the heavy ($V_H$) and light chains ($V_L$) of an antibody, connected with a short linker peptide of ten to about 25 amino acids. The linker is usually rich in glycine for flexibility, as well as serine or threonine for solubility, and can either connect the N-terminus of the $V_H$ with the C-terminus of the $V_L$, or vice versa. This protein retains the specificity of the original antibody, despite removal of the constant regions and the introduction of the linker. scFv antibodies are, e.g. described in Houston, J. S., Methods in Enzymol. 203 (1991) 46-96). In addition, antibody fragments comprise single chain polypeptides having the characteristics of a VH domain, namely being able to assemble together with a VL domain, or of a VL domain, namely being able to assemble together with a VH domain to a functional antigen binding site and thereby providing the antigen binding property of full length antibodies.

"Scaffold antigen binding proteins" are known in the art, for example, fibronectin and designed ankyrin repeat proteins (DARPINs®) have been used as alternative scaffolds for antigen-binding domains, see, e.g., Gebauer and Skerra, Engineered protein scaffolds as next-generation antibody therapeutics. Curr Opin Chem Biol 13:245-255 (2009) and Stumpp et al., Darpins: A new generation of protein therapeutics. Drug Discovery Today 13: 695-701 (2008). In one aspect of the invention, a scaffold antigen binding protein is selected from the group consisting of CTLA-4 (Evibody), Lipocalins (ANTICALIN®), a Protein A-derived molecule such as Z-domain of Protein A (AFFIBODY®), an A-domain (Avimer/Maxibody), a serum transferrin (trans-body); a designed ankyrin repeat protein (DARPIN®), a variable domain of antibody light chain or heavy chain (single-domain antibody, sdAb), a variable domain of antibody heavy chain (nanobody, aVH), $V_{NAR}$ fragments, a fibronectin (AdNectin), a C-type lectin domain (Tetranectin); a variable domain of a new antigen receptor beta-lactamase ($V_{NAR}$ fragments), a human gamma-crystallin or ubiquitin (AFFILIN® molecules); a kunitz type domain of human protease inhibitors, microbodies such as the proteins from the knottin family, peptide aptamers and fibronectin (adnectin).

CTLA-4 (Cytotoxic T Lymphocyte-associated Antigen 4) is a CD28-family receptor expressed on mainly CD4+ T-cells. Its extracellular domain has a variable domain-like Ig fold. Loops corresponding to CDRs of antibodies can be substituted with heterologous sequence to confer different binding properties. CTLA-4 molecules engineered to have different binding specificities are also known as Evibodies (e.g. U.S. Pat. No. 7,166,697B1). Evibodies are around the same size as the isolated variable region of an antibody (e.g. a domain antibody). For further details see Journal of Immunological Methods 248 (1-2), 31-45 (2001).

Lipocalins are a family of extracellular proteins which transport small hydrophobic molecules such as steroids, bilins, retinoids and lipids. They have a rigid beta-sheet secondary structure with a number of loops at the open end of the conical structure which can be engineered to bind to different target antigens. ANTICALINs® are between 160-180 amino acids in size, and are derived from lipocalins. For further details see Biochim Biophys Acta 1482: 337-350 (2000), U.S. Pat. No. 7,250,297B1 and US20070224633.

An AFFIBODY® is a scaffold derived from Protein A of *Staphylococcus aureus* which can be engineered to bind to antigen. The domain consists of a three-helical bundle of approximately 58 amino acids. Libraries have been generated by randomization of surface residues. For further details see Protein Eng. Des. Sel. 17, 455-462 (2004) and EP 1641818A1.

Avimers are multidomain proteins derived from the A-domain scaffold family. The native domains of approximately 35 amino acids adopt a defined disulfide bonded structure. Diversity is generated by shuffling of the natural variation exhibited by the family of A-domains. For further details see Nature Biotechnology 23(12), 1556-1561 (2005) and Expert Opinion on Investigational Drugs 16(6), 909-917 (June 2007).

A transferrin is a monomeric serum transport glycoprotein. Transferrins can be engineered to bind different target antigens by insertion of peptide sequences in a permissive surface loop. Examples of engineered transferrin scaffolds include the Trans-body. For further details see J. Biol. Chem 274, 24066-24073 (1999).

Designed Ankyrin Repeat Proteins (DARPINs®) are derived from Ankyrin which is a family of proteins that mediate attachment of integral membrane proteins to the cytoskeleton. A single ankyrin repeat is a 33 residue motif consisting of two alpha-helices and a beta-turn. They can be engineered to bind different target antigens by randomizing residues in the first alpha-helix and a beta-turn of each repeat. Their binding interface can be increased by increasing the number of modules (a method of affinity maturation). For further details see J. Mol. Biol. 332, 489-503 (2003), PNAS 100(4), 1700-1705 (2003) and J. Mol. Biol. 369, 1015-1028 (2007) and US20040132028A1.

A single-domain antibody is an antibody fragment consisting of a single monomeric variable antibody domain. The first single domain were derived from the variable domain of the antibody heavy chain from camelids (nanobodies or $V_HH$ fragments). Furthermore, the term single-domain antibody includes an autonomous human heavy chain variable domain (aVH) or $V_{NAR}$ fragments derived from sharks.

Fibronectin is a scaffold which can be engineered to bind to antigen. Adnectins consists of a backbone of the natural amino acid sequence of the 10th domain of the 15 repeating units of human fibronectin type III (FN3). Three loops at one end of the .beta.-sandwich can be engineered to enable an Adnectin to specifically recognize a therapeutic target of interest. For further details see Protein Eng. Des. Sel. 18, 435-444 (2005), US20080139791, WO2005056764 and U.S. Pat. No. 6,818,418B1.

Peptide aptamers are combinatorial recognition molecules that consist of a constant scaffold protein, typically thioredoxin (TrxA) which contains a constrained variable peptide loop inserted at the active site. For further details see Expert Opin. Biol. Ther. 5, 783-797 (2005).

Microbodies are derived from naturally occurring microproteins of 25-50 amino acids in length which contain 3-4 cysteine bridges—examples of microproteins include KalataBl and conotoxin and knottins. The microproteins have a loop which can beengineered to include upto 25 amino acids without affecting the overall fold of the microprotein. For further details of engineered knottin domains, see WO2008098796.

An "antigen binding molecule that binds to the same epitope" as a reference molecule refers to an antigen binding molecule that blocks binding of the reference molecule to its antigen in a competition assay by 50% or more, and conversely, the reference molecule blocks binding of the antigen binding molecule to its antigen in a competition assay by 50% or more.

The term "antigen binding domain" refers to the part of an antigen binding molecule that comprises the area which specifically binds to and is complementary to part or all of an antigen. Where an antigen is large, an antigen binding molecule may only bind to a particular part of the antigen, which part is termed an epitope. An antigen binding domain may be provided by, for example, one or more variable domains (also called variable regions). Preferably, an antigen binding domain comprises an antibody light chain variable region (VL) and an antibody heavy chain variable region (VH).

As used herein, the term "antigenic determinant" is synonymous with "antigen" and "epitope," and refers to a site (e.g. a contiguous stretch of amino acids or a conformational configuration made up of different regions of non-contiguous amino acids) on a polypeptide macromolecule to which an antigen binding moiety binds, forming an antigen binding moiety-antigen complex. Useful antigenic determinants can be found, for example, on the surfaces of tumor cells, on the surfaces of virus-infected cells, on the surfaces of other diseased cells, on the surface of immune cells, free in blood serum, and/or in the extracellular matrix (ECM). The proteins useful as antigens herein can be any native form the proteins from any vertebrate source, including mammals such as primates (e.g. humans) and rodents (e.g. mice and rats), unless otherwise indicated. In a particular embodiment the antigen is a human protein. Where reference is made to a specific protein herein, the term encompasses the "full-length", unprocessed protein as well as any form of the protein that results from processing in the cell. The term also encompasses naturally occurring variants of the protein, e.g. splice variants or allelic variants.

By "specific binding" is meant that the binding is selective for the antigen and can be discriminated from unwanted or non-specific interactions. The ability of an antigen binding molecule to bind to a specific antigen can be measured either through an enzyme-linked immunosorbent assay (ELISA) or other techniques familiar to one of skill in the art, e.g. Surface Plasmon Resonance (SPR) technique (analyzed on a BIACORE® instrument) (Liljeblad et al., Glyco J 17, 323-329 (2000)), and traditional binding assays (Heeley, Endocr Res 28, 217-229 (2002)). In one embodiment, the extent of binding of an antigen binding molecule to an unrelated protein is less than about 10% of the binding of the antigen binding molecule to the antigen as measured, e.g. by SPR. In certain embodiments, an molecule that binds to the antigen has a dissociation constant (Kd) of $\leq 1$ µM, $\leq 100$ nM, $\leq 10$ nM, $\leq 1$ nM, $\leq 0.1$ nM, $\leq 0.01$ nM, or $\leq 0.001$ nM (e.g. $10^{-8}$ M or less, e.g. from $10^{-8}$ M to $10^{-13}$ M, e.g. from $10^{-9}$ M to $10^{-13}$ M).

"Affinity" or "binding affinity" refers to the strength of the sum total of non-covalent interactions between a single binding site of a molecule (e.g. an antibody) and its binding partner (e.g. an antigen). Unless indicated otherwise, as used herein, "binding affinity" refers to intrinsic binding affinity which reflects a 1:1 interaction between members of a binding pair (e.g. antibody and antigen). The affinity of a molecule X for its partner Y can generally be represented by the dissociation constant (Kd), which is the ratio of dissociation and association rate constants (koff and kon, respectively). Thus, equivalent affinities may comprise different rate constants, as long as the ratio of the rate constants remains the same. Affinity can be measured by common methods known in the art, including those described herein. A particular method for measuring affinity is Surface Plasmon Resonance (SPR).

A "target cell antigen" as used herein refers to an antigenic determinant presented on the surface of a target cell, for example a cell in a tumor such as a cancer cell or a cell of the tumor stroma. In certain embodiments, the target cell antigen is an antigen on the surface of a tumor cell. In one embodiment, target cell antigen is selected from the group consisting of Fibroblast Activation Protein (FAP), Carcinoembryonic Antigen (CEA), Melanoma-associated Chondroitin Sulfate Proteoglycan (MCSP), Epidermal Growth Factor Receptor (EGFR), CD19, CD20 and CD33. In particular, the target cell antigen is Fibroblast Activation Protein (FAP).

The term "Fibroblast activation protein (FAP)", also known as Prolyl endopeptidase FAP or Seprase (EC 3.4.21), refers to any native FAP from any vertebrate source, including mammals such as primates (e.g. humans) non-human primates (e.g. cynomolgus monkeys) and rodents (e.g. mice and rats), unless otherwise indicated. The term encompasses "full-length," unprocessed FAP as well as any form of FAP which results from processing in the cell. The term also encompasses naturally occurring variants of FAP, e.g., splice variants or allelic variants. In one embodiment, the antigen binding molecule of the invention is capable of specific binding to human, mouse and/or cynomolgus FAP. The amino acid sequence of human FAP is shown in UniProt accession no. Q12884 (version 149, SEQ ID NO:20), or NCBI RefSeq NP 004451.2. The extracellular domain (ECD) of human FAP extends from amino acid position 26 to 760. The amino acid and nucleotide sequences of a His-tagged human FAP ECD is shown in SEQ ID NOs 15 and 16, respectively. The amino acid sequence of mouse FAP is shown in UniProt accession no. P97321 (version 126, SEQ ID NO:23), or NCBI RefSeq NP 032012.1. The extracellular domain (ECD) of mouse FAP extends from amino acid position 26 to 761. SEQ ID NOs 24 and 25 show the amino acid and nucleotide sequences, respectively, of a His-tagged mouse FAP ECD. SEQ ID NOs 26 and 27 show the amino acid and nucleotide sequences, respectively, of a His-tagged cynomolgus FAP ECD. Preferably, an anti-FAP binding molecule of the invention binds to the extracellular domain of FAP. Exemplary anti-FAP binding molecules are described in International Patent Application No. WO 2012/020006 A2.

The term "Carcinoembroynic antigen (CEA)", also known as Carcinoembryonic antigen-related cell adhesion molecule 5 (CEACAM5), refers to any native CEA from any vertebrate source, including mammals such as primates (e.g. humans) non-human primates (e.g. cynomolgus monkeys) and rodents (e.g. mice and rats), unless otherwise indicated. The amino acid sequence of human CEA is shown in UniProt accession no. P06731 (version 151, SEQ ID NO:28). CEA has long been identified as a tumor-associated antigen (Gold and Freedman, J Exp Med., 121:439-462, 1965; Berinstein N. L., J Clin Oncol., 20:2197-2207, 2002). Originally classified as a protein expressed only in fetal tissue, CEA has now been identified in several normal adult tissues. These tissues are primarily epithelial in origin, including cells of the gastrointestinal, respiratory, and urogential tracts, and cells of colon, cervix, sweat glands, and prostate (Nap et al., Tumour Biol., 9(2-3):145-53, 1988; Nap et al., Cancer Res., 52(8):2329-23339, 1992). Tumors of epithelial origin, as well as their metastases, contain CEA as a tumor associated antigen. While the presence of CEA itself does not indicate transformation to a cancerous cell, the distribution of CEA is indicative. In normal tissue, CEA is generally expressed on the apical surface of the cell (Hammarstrom S., Semin Cancer Biol. 9(2):67-81 (1999)), making it inaccessible to antibody in the blood stream. In contrast to normal tissue, CEA tends to be expressed over the entire surface of cancerous cells (Hammarstrom S., Semin Cancer Biol. 9(2):67-81 (1999)). This change of expression pattern makes CEA accessible to antibody binding in cancerous cells. In addition, CEA expression increases in cancerous cells. Furthermore, increased CEA expression promotes increased intercellular adhesions, which may lead to metastasis (Marshall J., Semin Oncol., 30(a Suppl. 8):30-6, 2003). The prevalence of CEA expression in various tumor entities is generally very high. In concordance with published data, own analyses performed in tissue samples confirmed its high prevalence, with approximately 95% in colorectal carcinoma (CRC), 90% in pancreatic cancer, 80% in gastric cancer, 60% in non-small cell lung cancer (NSCLC, where it is co-expressed with HER3), and 40% in breast cancer; low expression was found in small cell lung cancer and glioblastoma.

CEA is readily cleaved from the cell surface and shed into the blood stream from tumors, either directly or via the lymphatics. Because of this property, the level of serum CEA has been used as a clinical marker for diagnosis of cancers and screening for recurrence of cancers, particularly colorectal cancer (Goldenberg D M., The International Journal of Biological Markers, 7:183-188, 1992; Chau I., et al., J Clin Oncol., 22:1420-1429, 2004; Flamini et al., Clin Cancer Res; 12(23):6985-6988, 2006).

The term "Melanoma-associated Chondroitin Sulfate Proteoglycan (MCSP)", also known as Chondroitin Sulfate Proteoglycan 4 (CSPG4) refers to any native MCSP from any vertebrate source, including mammals such as primates (e.g. humans) non-human primates (e.g. cynomolgus monkeys) and rodents (e.g. mice and rats), unless otherwise indicated. The amino acid sequence of human MCSP is shown in UniProt accession no. Q6UVK1 (version 103, SEQ ID NO:29). The term "Epidermal Growth Factor Receptor (EGFR)", also named Proto-oncogene c-ErbB-1 or Receptor tyrosine-protein kinase erbB-1, refers to any native EGFR from any vertebrate source, including mammals such as primates (e.g. humans) non-human primates (e.g. cynomolgus monkeys) and rodents (e.g. mice and rats), unless otherwise indicated. The amino acid sequence of human EGFR is shown in UniProt accession no. P00533 (version 211, SEQ ID NO:30).

The term "CD19" refers to B-lymphocyte antigen CD19, also known as B-lymphocyte surface antigen B4 or T-cell surface antigen Leu-12 and includes any native CD19 from any vertebrate source, including mammals such as primates (e.g. humans) non-human primates (e.g. cynomolgus monkeys) and rodents (e.g. mice and rats), unless otherwise indicated. The amino acid sequence of human CD19 is shown in Uniprot accession no. P15391 (version 160, SEQ ID NO:31). The term encompasses "full-length" unprocessed human CD19 as well as any form of human CD19 that results from processing in the cell as long as the antibody as reported herein binds thereto. CD19 is a structurally distinct cell surface receptor expressed on the surface of human B cells, including, but not limited to, pre-B cells, B cells in early development {i.e., immature B cells), mature B cells through terminal differentiation into plasma cells, and malignant B cells. CD19 is expressed by most pre-B acute lymphoblastic leukemias (ALL), non-Hodgkin's lymphomas, B cell chronic lymphocytic leukemias (CLL), prolymphocytic leukemias, hairy cell leukemias, common acute lymphocytic leukemias, and some Null-acute lymphoblastic leukemias. The expression of CD19 on plasma cells further suggests it may be expressed on differentiated B cell tumors such as multiple myeloma. Therefore, the CD19 antigen is a target for immunotherapy in the treatment of non-Hodgkin's lymphoma, chronic lymphocytic leukemia and/or acute lymphoblastic leukemia.

"CD20" refers to B-lymphocyte antigen CD20, also known as membrane-spanning 4-domains subfamily A member 1 (MS4A1), B-lymphocyte surface antigen B1 or Leukocyte surface antigen Leu-16, and includes any native CD20 from any vertebrate source, including mammals such as primates (e.g. humans) non-human primates (e.g. cynomolgus monkeys) and rodents (e.g. mice and rats), unless otherwise indicated. The amino acid sequence of human CD20 is shown in Uniprot accession no. P11836 (version 149, SEQ ID NO:32). "CD33" refers to Myeloid cell surface antigen CD33, also known as SIGLEC3 or gp67, and includes any native CD33 from any vertebrate source, including mammals such as primates (e.g. humans) non-human primates (e.g. cynomolgus monkeys) and rodents (e.g. mice and rats), unless otherwise indicated. The amino acid sequence of human CD33 is shown in Uniprot accession no. P20138 (version 157, SEQ ID NO:33).

The term "variable region" or "variable domain" refers to the domain of an antibody heavy or light chain that is involved in binding the antigen binding molecule to antigen. The variable domains of the heavy chain and light chain (VH and VL, respectively) of a native antibody generally have similar structures, with each domain comprising four conserved framework regions (FRs) and three hypervariable regions (HVRs). See, e.g., Kindt et al., Kuby Immunology, 6th ed., W.H. Freeman and Co., page 91 (2007). A single VH or VL domain may be sufficient to confer antigen-binding specificity.

The term "hypervariable region" or "HVR," as used herein refers to each of the regions of an antibody variable domain which are hypervariable in sequence and/or form structurally defined loops ("hypervariable loops"). Generally, native four-chain antibodies comprise six HVRs; three in the VH (H1, H2, H3), and three in the VL (L1, L2, L3). HVRs generally comprise amino acid residues from the hypervariable loops and/or from the "complementarity determining regions" (CDRs), the latter being of highest sequence variability and/or involved in antigen recognition. Exemplary hypervariable loops occur at amino acid residues 26-32 (L1), 50-52 (L2), 91-96 (L3), 26-32 (H1), 53-55 (H2), and 96-101 (H3). (Chothia and Lesk, *J. Mol. Biol.* 196:901-917 (1987).) Exemplary CDRs (CDR-L1, CDR-L2, CDR-L3, CDR-H1, CDR-H2, and CDR-H3) occur at amino acid residues 24-34 of L1, 50-56 of L2, 89-97 of L3, 31-35B of H1, 50-65 of H2, and 95-102 of H3. (Kabat et al., *Sequences of Proteins of Immunological Interest,* 5th Ed. Public Health Service, National Institutes of Health, Bethesda, Md. (1991).) Hypervariable regions (HVRs) are also referred to as complementarity determining regions (CDRs), and these terms are used herein interchangeably in reference to portions of the variable region that form the antigen binding regions. This particular region has been described by Kabat et al., U.S. Dept. of Health and Human Services, "Sequences of Proteins of Immunological Interest" (1983) and by Chothia et al., *J. Mol. Biol.* 196:901-917 (1987), where the definitions include overlapping or subsets of amino acid residues when compared against each other. Nevertheless, application of either definition to refer to a CDR of an antibody or variants thereof is intended to be within the scope of the term as defined and used herein. The appropriate amino acid residues which encompass the CDRs as defined by each of the above cited references are set forth below in Table A as a comparison. The exact residue numbers which encompass a particular CDR will vary depending on the sequence and size of the CDR. Those skilled in the art can routinely determine which residues comprise a particular CDR given the variable region amino acid sequence of the antibody.

TABLE A

| CDR Definitions[1] | | | |
|---|---|---|---|
| CDR | Kabat | Chothia | AbM[2] |
| $V_H$ CDR1 | 31-35 | 26-32 | 26-35 |
| $V_H$ CDR2 | 50-65 | 52-58 | 50-58 |
| $V_H$ CDR3 | 95-102 | 95-102 | 95-102 |
| $V_L$ CDR1 | 24-34 | 26-32 | 24-34 |
| $V_L$ CDR2 | 50-56 | 50-52 | 50-56 |
| $V_L$ CDR3 | 89-97 | 91-96 | 89-97 |

[1]Numbering of all CDR definitions in Table A is according to the numbering conventions set forth by Kabat et al. (see below).
[2]"AbM" with a lowercase "b" as used in Table A refers to the CDRs as defined by Oxford Molecular's "AbM" antibody modeling software.

Kabat et al. also defined a numbering system for variable region sequences that is applicable to any antibody. One of ordinary skill in the art can unambiguously assign this system of "Kabat numbering" to any variable region sequence, without reliance on any experimental data beyond the sequence itself. As used herein, "Kabat numbering" refers to the numbering system set forth by Kabat et al., U.S. Dept. of Health and Human Services, "Sequence of Proteins of Immunological Interest" (1983). Unless otherwise specified, references to the numbering of specific amino acid residue positions in an antibody variable region are according to the Kabat numbering system.

With the exception of CDR1 in VH, CDRs generally comprise the amino acid residues that form the hypervariable loops. CDRs also comprise "specificity determining residues," or "SDRs," which are residues that contact antigen. SDRs are contained within regions of the CDRs called abbreviated-CDRs, or a-CDRs. Exemplary a-CDRs (a-CDR-L1, a-CDR-L2, a-CDR-L3, a-CDR-H1, a-CDR-H2, and a-CDR-H3) occur at amino acid residues 31-34 of L1, 50-55 of L2, 89-96 of L3, 31-35B of H1, 50-58 of H2, and 95-102 of H3. (See Almagro and Fransson, *Front. Biosci.* 13:1619-1633 (2008).) Unless otherwise indicated, HVR residues and other residues in the variable domain (e.g., FR residues) are numbered herein according to Kabat et al., supra.

As used herein, the term "affinity matured" in the context of antigen binding molecules (e.g., antibodies) refers to an antigen binding molecule that is derived from a reference antigen binding molecule, e.g., by mutation, binds to the same antigen, preferably binds to the same epitope, as the reference antibody; and has a higher affinity for the antigen than that of the reference antigen binding molecule. Affinity maturation generally involves modification of one or more amino acid residues in one or more CDRs of the antigen binding molecule. Typically, the affinity matured antigen binding molecule binds to the same epitope as the initial reference antigen binding molecule.

"Framework" or "FR" refers to variable domain residues other than hypervariable region (HVR) residues. The FR of a variable domain generally consists of four FR domains: FR1, FR2, FR3, and FR4. Accordingly, the HVR and FR sequences generally appear in the following sequence in VH (or VL): FR1-H1(L1)-FR2-H2(L2)-FR3-H3(L3)-FR4.

An "acceptor human framework" for the purposes herein is a framework comprising the amino acid sequence of a light chain variable domain (VL) framework or a heavy chain variable domain (VH) framework derived from a human immunoglobulin framework or a human consensus framework, as defined below. An acceptor human framework "derived from" a human immunoglobulin framework or a human consensus framework may comprise the same amino acid sequence thereof, or it may contain amino acid sequence changes. In some embodiments, the number of amino acid changes are 10 or less, 9 or less, 8 or less, 7 or less, 6 or less, 5 or less, 4 or less, 3 or less, or 2 or less. In some embodiments, the VL acceptor human framework is identical in sequence to the VL human immunoglobulin framework sequence or human consensus framework sequence.

The term "chimeric" antibody refers to an antibody in which a portion of the heavy and/or light chain is derived from a particular source or species, while the remainder of the heavy and/or light chain is derived from a different source or species.

The "class" of an antibody refers to the type of constant domain or constant region possessed by its heavy chain. There are five major classes of antibodies: IgA, IgD, IgE, IgG, and IgM, and several of these may be further divided into subclasses (isotypes), e.g. $IgG_1$, $IgG_2$, $IgG_3$, $IgG_4$, $IgA_1$, and $IgA_2$. The heavy chain constant domains that correspond to the different classes of immunoglobulins are called α, δ, ε, γ, and μ respectively.

A "humanized" antibody refers to a chimeric antibody comprising amino acid residues from non-human HVRs and amino acid residues from human FRs. In certain embodiments, a humanized antibody will comprise substantially all of at least one, and typically two, variable domains, in which all or substantially all of the HVRs (e.g., CDRs) correspond to those of a non-human antibody, and all or substantially all of the FRs correspond to those of a human antibody. A humanized antibody optionally may comprise at least a portion of an antibody constant region derived from a human antibody. A "humanized form" of an antibody, e.g., a non-human antibody, refers to an antibody that has undergone humanization. Other forms of "humanized antibodies" encompassed by the present invention are those in which the constant region has been additionally modified or changed from that of the original antibody to generate the properties according to the invention, especially in regard to C1q binding and/or Fc receptor (FcR) binding.

A "human" antibody is one which possesses an amino acid sequence which corresponds to that of an antibody produced by a human or a human cell or derived from a non-human source that utilizes human antibody repertoires or other human antibody-encoding sequences. This definition of a human antibody specifically excludes a humanized antibody comprising non-human antigen-binding residues.

The term "Fc domain" or "Fc region" herein is used to define a C-terminal region of an antibody heavy chain that contains at least a portion of the constant region. The term includes native sequence Fc regions and variant Fc regions. An IgG Fc region comprises an IgG CH2 and an IgG CH3 domain. The "CH2 domain" of a human IgG Fc region usually extends from an amino acid residue at about position 231 to an amino acid residue at about position 340. In one embodiment, a carbohydrate chain is attached to the CH2 domain. The CH2 domain herein may be a native sequence CH2 domain or variant CH2 domain. The "CH3 domain" comprises the stretch of residues C-terminal to a CH2 domain in an Fc region (i.e. from an amino acid residue at about position 341 to an amino acid residue at about position 447 of an IgG). The CH3 region herein may be a native sequence CH3 domain or a variant CH3 domain (e.g. a CH3 domain with an introduced "protuberance" ("knob") in one chain thereof and a corresponding introduced "cavity" ("hole") in the other chain thereof; see U.S. Pat. No. 5,821,333, expressly incorporated herein by reference). Such variant CH3 domains may be used to promote heterodimerization of two non-identical antibody heavy chains as herein described. In one embodiment, a human IgG heavy chain Fc region extends from Cys226, or from Pro230, to the carboxyl-terminus of the heavy chain. However, the C-terminal lysine (Lys447) of the Fc region may or may not be present. Unless otherwise specified herein, numbering of amino acid residues in the Fc region or constant region is according to the EU numbering system, also called the EU index, as described in Kabat et al., Sequences of Proteins of Immunological Interest, 5th Ed. Public Health Service, National Institutes of Health, Bethesda, Md., 1991.

The "knob-into-hole" technology is described e.g. in U.S. Pat. Nos. 5,731,168; 7,695,936; Ridgway et al., Prot Eng 9, 617-621 (1996) and Carter, J Immunol Meth 248, 7-15 (2001). Generally, the method involves introducing a protuberance ("knob") at the interface of a first polypeptide and a corresponding cavity ("hole") in the interface of a second polypeptide, such that the protuberance can be positioned in the cavity so as to promote heterodimer formation and hinder homodimer formation. Protuberances are constructed by replacing small amino acid side chains from the interface of the first polypeptide with larger side chains (e.g. tyrosine or tryptophan). Compensatory cavities of identical or similar size to the protuberances are created in the interface of the second polypeptide by replacing large amino acid side chains with smaller ones (e.g. alanine or threonine). The protuberance and cavity can be made by altering the nucleic acid encoding the polypeptides, e.g. by site-specific mutagenesis, or by peptide synthesis. In a specific embodiment a knob modification comprises the amino acid substitution T366W in one of the two subunits of the Fc domain, and the hole modification comprises the amino acid substitutions T366S, L368A and Y407V in the other one of the two subunits of the Fc domain. In a further specific embodiment, the subunit of the Fc domain comprising the knob modification additionally comprises the amino acid substitution S354C, and the subunit of the Fc domain comprising the hole modification additionally comprises the amino acid substitution Y349C. Introduction of these two cysteine residues results in the formation of a disulfide bridge between the two subunits of the Fc region, thus further stabilizing the dimer (Carter, J Immunol Methods 248, 7-15 (2001)). The numbering is according to EU index of Kabat et al, Sequences of Proteins of Immunological Interest, 5th Ed. Public Health Service, National Institutes of Health, Bethesda, Md., 1991.

A "region equivalent to the Fc region of an immunoglobulin" is intended to include naturally occurring allelic variants of the Fc region of an immunoglobulin as well as variants having alterations which produce substitutions, additions, or deletions but which do not decrease substantially the ability of the immunoglobulin to mediate effector functions (such as antibody-dependent cellular cytotoxicity). For example, one or more amino acids can be deleted from the N-terminus or C-terminus of the Fc region of an immunoglobulin without substantial loss of biological function. Such variants can be selected according to general rules known in the art so as to have minimal effect on activity (see, e.g., Bowie, J. U. et al., Science 247:1306-10 (1990)).

The term "effector functions" refers to those biological activities attributable to the Fc region of an antibody, which vary with the antibody isotype. Examples of antibody effector functions include: C1q binding and complement dependent cytotoxicity (CDC), Fc receptor binding, antibody-dependent cell-mediated cytotoxicity (ADCC), antibody-dependent cellular phagocytosis (ADCP), cytokine secretion, immune complex-mediated antigen uptake by antigen presenting cells, down regulation of cell surface receptors (e.g. B cell receptor), and B cell activation.

An "activating Fc receptor" is an Fc receptor that following engagement by an Fc region of an antibody elicits signaling events that stimulate the receptor-bearing cell to perform effector functions. Activating Fc receptors include FcγRIIIa (CD16a), FcγRI (CD64), FcγRIIa (CD32), and FcαRI (CD89). A particular activating Fc receptor is human FcγRIIIa (see UniProt accession no. P08637, version 141).

The term "TNF ligand family member" or "TNF family ligand" refers to a proinflammatory cytokine. Cytokines in general, and in particular the members of the TNF ligand family, play a crucial role in the stimulation and coordination of the immune system. At present, nineteen cyctokines have been identified as members of the TNF (tumour necrosis factor) ligand superfamily on the basis of sequence, functional, and structural similarities. All these ligands are type II transmembrane proteins with a C-terminal extracellular domain (ectodomain), N-terminal intracellular domain and a single transmembrane domain. The C-terminal extracellular domain, known as TNF homology domain (THD), has 20-30% amino acid identity between the superfamily members and is responsible for binding to the receptor. The TNF ectodomain is also responsible for the TNF ligands to form trimeric complexes that are recognized by their specific receptors.

Members of the TNF ligand family are selected from the group consisting of Lymphotoxin α (also known as LTA or TNFSF1), TNF (also known as TNFSF2), LTl3 (also known as TNFSF3), OX40L (also known as TNFSF4), CD40L (also known as CD154 or TNFSF5), FasL (also known as CD95L, CD178 or TNFSF6), CD27L (also known as CD70 or TNFSF7), CD30L (also known as CD153 or TNFSF8), 4-1BBL (also known as TNFSF9), TRAIL (also known as APO2L, CD253 or TNFSF10), RANKL (also known as CD254 or TNFSF11), TWEAK (also known as TNFSF12), APRIL (also known as CD256 or TNFSF13), BAFF (also known as CD257 or TNFSF13B), LIGHT (also known as CD258 or TNFSF14), TL1A (also known as VEGI or TNFSF15), GITRL (also known as TNFSF18), EDA-A1 (also known as ectodysplasin A1) and EDA-A2 (also known as ectodysplasin A2). The term refers to any native TNF family ligand from any vertebrate source, including mammals such as primates (e.g. humans), non-human primates (e.g. cynomolgus monkeys) and rodents (e.g. mice and rats), unless otherwise indicated. In specific embodiments of the invention, the TNF ligand family member is selected from the group consisting of OX40L, FasL, CD27L, TRAIL, 4-1BBL, CD40L and GITRL. In a particular embodiment, the TNF ligand family member is selected from 4-1BBL and OX40L.

Further information, in particular sequences, of the TNF ligand family members may be obtained from publically accessible databases such as Uniprot. For instance, the human TNF ligands have the following amino acid sequences: human Lymphotoxin α (UniProt accession no. P01374, SEQ ID NO:34), human TNF (UniProt accession no. P01375, SEQ ID NO:35), human Lymphotoxin β (UniProt accession no. Q06643, SEQ ID NO:36), human OX40L (UniProt accession no. P23510, SEQ ID NO:37), human CD40L (UniProt accession no. P29965, SEQ ID NO:38), human FasL (UniProt accession no. P48023, SEQ ID NO:39), human CD27L (UniProt accession no. P32970, SEQ ID NO:40), human CD30L (UniProt accession no. P32971, SEQ ID NO:41), 4-1BBL (UniProt accession no. P41273, SEQ ID NO:42), TRAIL (UniProt accession no. P50591, SEQ ID NO:43), RANKL (UniProt accession no. 014788, SEQ ID NO:44), TWEAK (UniProt accession no. 043508, SEQ ID NO:45), APRIL (UniProt accession no. 075888, SEQ ID NO:46), BAFF (UniProt accession no. Q9Y275, SEQ ID NO:47), LIGHT (UniProt accession no. 043557, SEQ ID NO:48), TL1A (UniProt accession no. 095150, SEQ ID NO:49), GITRL (UniProt accession no. Q9UNG2, SEQ ID NO:50) and ectodysplasin A (UniProt accession no. Q92838, SEQ ID NO:51).

An "ectodomain" is the domain of a membrane protein that extends into the extracellular space (i.e. the space outside the target cell). Ectodomains are usually the parts of proteins that initiate contact with surfaces, which leads to signal transduction. The ectodomain of TNF ligand family member as defined herein thus refers to the part of the TNF ligand protein that extends into the extracellular space (the extracellular domain), but also includes shorter parts or fragments thereof that are responsible for the trimerization and for the binding to the corresponding TNF receptor. The term "ectodomain of a TNF ligand family member or a fragment thereof" thus refers to the extracellular domain of the TNF ligand family member that forms the extracellular domain or to parts thereof that are still able to bind to the receptor (receptor binding domain).

The term "costimulatory TNF ligand family member" or "costimulatory TNF family ligand" refers to a subgroup of TNF ligand family members, which are able to costimulate proliferation and cytokine production of T-cells. These TNF family ligands can costimulate TCR signals upon interaction with their corresponding TNF receptors and the interaction with their receptors leads to recruitment of TNFR-associated factors (TRAF), which initiate signalling cascades that result in T-cell activation. Costimulatory TNF family ligands are selected from the group consisting of 4-1BBL, OX40L, GITRL, CD70, CD30L and LIGHT, more particularly the costimulatory TNF ligand family member is selected from 4-1BBL and OX40L.

As described herein before, 4-1BBL is a type II transmembrane protein and one member of the TNF ligand family. Complete or full length 4-1BBL having the amino acid sequence of SEQ ID NO:42 has been described to form trimers on the surface of cells. The formation of trimers is enabled by specific motives of the ectodomain of 4-1BBL. Said motives are designated herein as "trimerization region". The amino acids 50-254 of the human 4-1BBL sequence (SEQ ID NO:52) form the extracellular domain of 4-1BBL, but even fragments thereof are able to form the trimers. In specific embodiments of the invention, the term "ectodomain of 4-1BBL or a fragment thereof" refers to a polypeptide having an amino acid sequence selected from SEQ ID NO:4 (amino acids 52-254 of human 4-1BBL), SEQ ID NO:1 (amino acids 71-254 of human 4-1BBL), SEQ ID NO:3 (amino acids 80-254 of human 4-1BBL) and SEQ ID NO:2 (amino acids 85-254 of human 4-1BBL) or a polypeptide having an amino acid sequence selected from SEQ ID NO:96 (amino acids 71-248 of human 4-1BBL), SEQ ID NO:375 (amino acids 52-248 of human 4-1BBL), SEQ ID NO:374 (amino acids 80-248 of human 4-1BBL) and SEQ ID NO:373 (amino acids 85-248 of human 4-1BBL), but also other fragments of the ectodomain capable of trimerization are included herein.

As described herein before, OX40L is another type II transmembrane protein and a further member of the TNF ligand family. Complete or full length human OX40L has the amino acid sequence of SEQ ID NO:37. The amino acids 51-183 of the human OX40L sequence (SEQ ID NO:53) form the extracellular domain of OX40L, but even fragments thereof that are able to form the trimers. In specific embodiments of the invention, the term "ectodomain of OX40L or a fragment thereof" refers to a polypeptide having an amino acid sequence selected from SEQ ID NO:53 (amino acids 51-183 of human OX40L) or SEQ ID NO:54 (amino acids 52-183 of human OX40L), but also other fragments of the ectodomain capable of trimerization are included herein.

The term "peptide linker" refers to a peptide comprising one or more amino acids, typically about 2 to 20 amino acids. Peptide linkers are known in the art or are described herein. Suitable, non-immunogenic linker peptides are, for example, $(G_4S)_n$, $(SG_4)_n$ or $G_4(SG_4)_n$ peptide linkers, wherein "n" is generally a number between 1 and 10, typically between 1 and 4, in particular 2, i.e. the peptides selected from the group consisting of GGGGS (SEQ ID NO:128), GGGGSGGGGS (SEQ ID NO:13), SGGGGSGGGG (SEQ ID NO:55) and GGGGSGGGGSGGGG (SEQ ID NO:56), but also include the sequences GSPGSSSSGS (SEQ ID NO:57), GSGSGSGS (SEQ ID NO:58), GSGSGNGS (SEQ ID NO:59), GGSGSGSG (SEQ ID NO:60), GGSGSG (SEQ ID NO:61), GGSG (SEQ ID NO:62), GGSGNGSG (SEQ ID NO:63), GGNGSGSG (SEQ ID NO:64) and GGNGSG (SEQ ID NO:65). Peptide linkers of particular interest are $(G4S)_1$ or GGGGS (SEQ ID NO:128), $(G_4S)_2$ or GGGGSGGGGS (SEQ ID NO:13) and GSPGSSSSGS (SEQ ID NO:57), more particularly $(G_4S)_2$ or GGGGSGGGGS (SEQ ID NO:13) and GSPGSSSSGS (SEQ ID NO:57).

The term "amino acid" as used within this application denotes the group of naturally occurring carboxy α-amino acids comprising alanine (three letter code: ala, one letter code: A), arginine (arg, R), asparagine (asn, N), aspartic acid (asp, D), cysteine (cys, C), glutamine (gln, Q), glutamic acid (glu, E), glycine (gly, G), histidine (his, H), isoleucine (ile, I), leucine (leu, L), lysine (lys, K), methionine (met, M), phenylalanine (phe, F), proline (pro, P), serine (ser, S), threonine (thr, T), tryptophan (trp, W), tyrosine (tyr, Y), and valine (val, V).

A "single chain fusion protein" as used herein refers to a single chain polypeptide composed of one or two ectodomains of said TNF ligand family member fused to a part of antigen binding moiety or Fc part. The fusion may occur by directly linking the N or C-terminal amino acid of the antigen binding moiety via a peptide linker to the C- or N-terminal amino acid of the ectodomain of said TNF ligand family member.

By "fused" or "connected" is meant that the components (e.g. a polypeptide and an ectodomain of said TNF ligand family member) are linked by peptide bonds, either directly or via one or more peptide linkers.

"Percent (%) amino acid sequence identity" with respect to a reference polypeptide (protein) sequence is defined as the percentage of amino acid residues in a candidate sequence that are identical with the amino acid residues in the reference polypeptide sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN. SAWI or Megalign (DNASTAR) software. Those skilled in the art can determine appropriate parameters for aligning sequences, including any algorithms needed to achieve maximal alignment over the full length of the sequences being compared. For purposes herein, however, % amino acid sequence identity values are generated using the sequence comparison computer program ALIGN-2. The ALIGN-2 sequence comparison computer program was authored by Genentech, Inc., and the source code has been filed with user documentation in the U.S. Copyright Office, Washington D.C., 20559, where it is registered under U.S. Copyright Registration No. TXU510087. The ALIGN-2 program is publicly available from Genentech, Inc., South San Francisco, Calif., or may be compiled from the source code. The ALIGN-2 program should be compiled for use on a UNIX operating system, including digital UNIX V4.0D. All sequence comparison parameters are set by the ALIGN-2 program and do not vary. In situations where ALIGN-2 is employed for amino acid sequence comparisons, the % amino acid sequence identity of a given amino acid sequence A to, with, or against a given amino acid sequence B (which can alternatively be phrased as a given amino acid sequence A that has or comprises a certain % amino acid sequence identity to, with, or against a given amino acid sequence B) is calculated as follows:

$$100 \text{ times the fraction } X/Y$$

where X is the number of amino acid residues scored as identical matches by the sequence alignment program ALIGN-2 in that program's alignment of A and B, and where Y is the total number of amino acid residues in B. It will be appreciated that where the length of amino acid sequence A is not equal to the length of amino acid sequence B, the % amino acid sequence identity of A to B will not equal the % amino acid sequence identity of B to A. Unless specifically stated otherwise, all % amino acid sequence identity values used herein are obtained as described in the immediately preceding paragraph using the ALIGN-2 computer program.

In certain embodiments, amino acid sequence variants of the TNF ligand trimer-containing antigen binding molecules provided herein are contemplated. For example, it may be desirable to improve the binding affinity and/or other biological properties of the TNF ligand trimer-containing antigen binding molecules. Amino acid sequence variants of the TNF ligand trimer-containing antigen binding molecules may be prepared by introducing appropriate modifications into the nucleotide sequence encoding the molecules, or by peptide synthesis. Such modifications include, for example, deletions from, and/or insertions into and/or substitutions of residues within the amino acid sequences of the antibody. Any combination of deletion, insertion, and substitution can be made to arrive at the final construct, provided that the final construct possesses the desired characteristics, e.g., antigen-binding. Sites of interest for substitutional mutagenesis include the HVRs and Framework (FRs). Conservative substitutions are provided in Table B under the heading "Preferred Substitutions" and further described below in reference to amino acid side chain classes (1) to (6). Amino acid substitutions may be introduced into the molecule of interest and the products screened for a desired activity, e.g., retained/improved antigen binding, decreased immunogenicity, or improved ADCC or CDC.

TABLE B

| Original Residue | Exemplary Substitutions | Preferred Substitutions |
|---|---|---|
| Ala (A) | Val; Leu; Ile | Val |
| Arg (R) | Lys; Gln; Asn | Lys |

TABLE B-continued

| Original Residue | Exemplary Substitutions | Preferred Substitutions |
|---|---|---|
| Asn (N) | Gln; His; Asp, Lys; Arg | Gln |
| Asp (D) | Glu; Asn | Glu |
| Cys (C) | Ser; Ala | Ser |
| Gln (Q) | Asn; Glu | Asn |
| Glu (E) | Asp; Gln | Asp |
| Gly (G) | Ala | Ala |
| His (H) | Asn; Gln; Lys; Arg | Arg |
| Ile (I) | Leu; Val; Met; Ala; Phe; Norleucine | Leu |
| Leu (L) | Norleucine; Ile; Val; Met; Ala; Phe | Ile |
| Lys (K) | Arg; Gln; Asn | Arg |
| Met (M) | Leu; Phe; Ile | Leu |
| Phe (F) | Trp; Leu; Val; Ile; Ala; Tyr | Tyr |
| Pro (P) | Ala | Ala |
| Ser (S) | Thr | Thr |
| Thr (T) | Val; Ser | Ser |
| Trp (W) | Tyr; Phe | Tyr |
| Tyr (Y) | Trp; Phe; Thr; Ser | Phe |
| Val (V) | Ile; Leu; Met; Phe; Ala; Norleucine | Leu |

Amino acids may be grouped according to common side-chain properties:

(1) hydrophobic: Norleucine, Met, Ala, Val, Leu, Ile;
(2) neutral hydrophilic: Cys, Ser, Thr, Asn, Gln;
(3) acidic: Asp, Glu;
(4) basic: His, Lys, Arg;
(5) residues that influence chain orientation: Gly, Pro;
(6) aromatic: Trp, Tyr, Phe.

Non-conservative substitutions will entail exchanging a member of one of these classes for another class.

The term "amino acid sequence variants" includes substantial variants wherein there are amino acid substitutions in one or more hypervariable region residues of a parent antigen binding molecule (e.g. a humanized or human antibody). Generally, the resulting variant(s) selected for further study will have modifications (e.g., improvements) in certain biological properties (e.g., increased affinity, reduced immunogenicity) relative to the parent antigen binding molecule and/or will have substantially retained certain biological properties of the parent antigen binding molecule. An exemplary substitutional variant is an affinity matured antibody, which may be conveniently generated, e.g., using phage display-based affinity maturation techniques such as those described herein. Briefly, one or more HVR residues are mutated and the variant antigen binding molecules displayed on phage and screened for a particular biological activity (e.g. binding affinity). In certain embodiments, substitutions, insertions, or deletions may occur within one or more HVRs so long as such alterations do not substantially reduce the ability of the antigen binding molecule to bind antigen. For example, conservative alterations (e.g., conservative substitutions as provided herein) that do not substantially reduce binding affinity may be made in HVRs. A useful method for identification of residues or regions of an antibody that may be targeted for mutagenesis is called "alanine scanning mutagenesis" as described by Cunningham and Wells (1989) Science, 244:1081-1085. In this method, a residue or group of target residues (e.g., charged residues such as Arg, Asp, His, Lys, and Glu) are identified and replaced by a neutral or negatively charged amino acid (e.g., alanine or polyalanine) to determine whether the interaction of the antibody with antigen is affected. Further substitutions may be introduced at the amino acid locations demonstrating functional sensitivity to the initial substitutions. Alternatively, or additionally, a crystal structure of an antigen-antigen binding molecule complex to identify contact points between the antibody and antigen. Such contact residues and neighboring residues may be targeted or eliminated as candidates for substitution. Variants may be screened to determine whether they contain the desired properties.

Amino acid sequence insertions include amino- and/or carboxyl-terminal fusions ranging in length from one residue to polypeptides containing a hundred or more residues, as well as intrasequence insertions of single or multiple amino acid residues. Examples of terminal insertions include TNF family ligand trimer-containing antigen binding molecule with an N-terminal methionyl residue. Other insertional variants of the molecule include the fusion to the N- or C-terminus to a polypeptide which increases the serum half-life of the TNF ligand trimer-containing antigen binding molecules.

In certain embodiments, the TNF family ligand trimer-containing antigen binding molecules provided herein are altered to increase or decrease the extent to which the antibody is glycosylated. Glycosylation variants of the molecules may be conveniently obtained by altering the amino acid sequence such that one or more glycosylation sites is created or removed. Where the TNF ligand trimer-containing antigen binding molecule comprises an Fc region, the carbohydrate attached thereto may be altered. Native antibodies produced by mammalian cells typically comprise a branched, biantennary oligosaccharide that is generally attached by an N-linkage to Asn297 of the CH2 domain of the Fc region. See, e.g., Wright et al. *TIBTECH* 15:26-32 (1997). The oligosaccharide may include various carbohydrates, e.g., mannose, N-acetyl glucosamine (GlcNAc), galactose, and sialic acid, as well as a fucose attached to a GlcNAc in the "stem" of the biantennary oligosaccharide structure. In some embodiments, modifications of the oligosaccharide in TNF family ligand trimer-containing antigen binding molecule may be made in order to create variants with certain improved properties. In one aspect, variants of TNF family ligand trimer-containing antigen binding molecules are provided having a carbohydrate structure that lacks fucose attached (directly or indirectly) to an Fc region. Such fucosylation variants may have improved ADCC function, see e.g. US Patent Publication Nos. US 2003/0157108 (Presta, L.) or US 2004/0093621 (Kyowa Hakko Kogyo Co., Ltd). Further variants of the TNF family ligand trimer-containing antigen binding molecules of the invention include those with bisected oligosaccharides, e.g., in which a biantennary oligosaccharide attached to the Fc region is bisected by GlcNAc. Such variants may have reduced fucosylation and/or improved ADCC function, see for example WO 2003/011878 (Jean-Mairet et al.); U.S. Pat. No. 6,602,684 (Umana et al.); and US 2005/0123546 (Umana et al.). Variants with at least one galactose residue in the oligosaccharide attached to the Fc region are also provided. Such antibody variants may have improved CDC function and are described, e.g., in WO 1997/30087 (Patel et al.); WO 1998/58964 (Raju, S.); and WO 1999/22764 (Raju, S.).

In certain embodiments, it may be desirable to create cysteine engineered variants of the TNF family ligand trimer-containing antigen binding molecule of the invention, e.g., "thioMAbs," in which one or more residues of the molecule are substituted with cysteine residues. In particular embodiments, the substituted residues occur at accessible sites of the molecule. By substituting those residues with cysteine, reactive thiol groups are thereby positioned at accessible sites of the antibody and may be used to conjugate the antibody to other moieties, such as drug moieties or linker-drug moieties, to create an immunoconjugate. In certain embodiments, any one or more of the following residues may be substituted with cysteine: V205 (Kabat numbering) of the light chain; A118 (EU numbering) of the heavy chain; and 5400 (EU numbering) of the heavy chain Fc region. Cysteine engineered antigen binding molecules may be generated as described, e.g., in U.S. Pat. No. 7,521,541.

In certain aspects, the TNF family ligand trimer-containing antigen binding molecules provided herein may be further modified to contain additional non-proteinaceous moieties that are known in the art and readily available. The moieties suitable for derivatization of the antibody include but are not limited to water soluble polymers. Non-limiting examples of water soluble polymers include, but are not limited to, polyethylene glycol (PEG), copolymers of ethylene glycol/propylene glycol, carboxymethylcellulose, dextran, polyvinyl alcohol, polyvinyl pyrrolidone, poly-1,3-dioxolane, poly-1,3,6-trioxane, ethylene/maleic anhydride copolymer, polyaminoacids (either homopolymers or random copolymers), and dextran or poly(n-vinyl pyrrolidone) polyethylene glycol, propropylene glycol homopolymers, prolypropylene oxide/ethylene oxide co-polymers, polyoxyethylated polyols (e.g., glycerol), polyvinyl alcohol, and mixtures thereof. Polyethylene glycol propionaldehyde may have advantages in manufacturing due to its stability in water. The polymer may be of any molecular weight, and may be branched or unbranched. The number of polymers attached to the antibody may vary, and if more than one polymer is attached, they can be the same or different molecules. In general, the number and/or type of polymers used for derivatization can be determined based on considerations including, but not limited to, the particular properties or functions of the antibody to be improved, whether the bispecific antibody derivative will be used in a therapy under defined conditions, etc. In another aspect, conjugates of an antibody and non-proteinaceous moiety that may be selectively heated by exposure to radiation are provided. In one embodiment, the non-proteinaceous moiety is a carbon nanotube (Kam, N. W. et al., Proc. Natl. Acad. Sci. USA 102 (2005) 11600-11605). The radiation may be of any wavelength, and includes, but is not limited to, wavelengths that do not harm ordinary cells, but which heat the non-proteinaceous moiety to a temperature at which cells proximal to the antibody-non-proteinaceous moiety are killed.

In another aspect, immunoconjugates of the TNF family ligand trimer-containing antigen binding molecules provided herein maybe obtained. An "immunoconjugate" is an antibody conjugated to one or more heterologous molecule(s), including but not limited to a cytotoxic agent.

The term "polynucleotide" refers to an isolated nucleic acid molecule or construct, e.g. messenger RNA (mRNA), virally-derived RNA, or plasmid DNA (pDNA). A polynucleotide may comprise a conventional phosphodiester bond or a non-conventional bond (e.g. an amide bond, such as found in peptide nucleic acids (PNA). The term "nucleic acid molecule" refers to any one or more nucleic acid segments, e.g. DNA or RNA fragments, present in a polynucleotide.

By "isolated" nucleic acid molecule or polynucleotide is intended a nucleic acid molecule, DNA or RNA, which has been removed from its native environment. For example, a recombinant polynucleotide encoding a polypeptide contained in a vector is considered isolated for the purposes of the present invention. Further examples of an isolated polynucleotide include recombinant polynucleotides maintained in heterologous host cells or purified (partially or substantially) polynucleotides in solution. An isolated polynucleotide includes a polynucleotide molecule contained in cells that ordinarily contain the polynucleotide molecule, but the polynucleotide molecule is present extrachromosomally or at a chromosomal location that is different from its natural chromosomal location. Isolated RNA molecules include in vivo or in vitro RNA transcripts of the present invention, as well as positive and negative strand forms, and double-stranded forms. Isolated polynucleotides or nucleic acids according to the present invention further include such molecules produced synthetically. In addition, a polynucleotide or a nucleic acid may be or may include a regulatory element such as a promoter, ribosome binding site, or a transcription terminator.

By a nucleic acid or polynucleotide having a nucleotide sequence at least, for example, 95% "identical" to a reference nucleotide sequence of the present invention, it is intended that the nucleotide sequence of the polynucleotide is identical to the reference sequence except that the polynucleotide sequence may include up to five point mutations per each 100 nucleotides of the reference nucleotide sequence. In other words, to obtain a polynucleotide having a nucleotide sequence at least 95% identical to a reference nucleotide sequence, up to 5% of the nucleotides in the reference sequence may be deleted or substituted with another nucleotide, or a number of nucleotides up to 5% of the total nucleotides in the reference sequence may be inserted into the reference sequence. These alterations of the reference sequence may occur at the 5' or 3' terminal positions of the reference nucleotide sequence or anywhere between those terminal positions, interspersed either individually among residues in the reference sequence or in one or more contiguous groups within the reference sequence. As a practical matter, whether any particular polynucleotide sequence is at least 80%, 85%, 90%, 95%, 96%, 97%, 98% or 99% identical to a nucleotide sequence of the present invention can be determined conventionally using known computer programs, such as the ones discussed above for polypeptides (e.g. ALIGN-2).

The term "expression cassette" refers to a polynucleotide generated recombinantly or synthetically, with a series of specified nucleic acid elements that permit transcription of a particular nucleic acid in a target cell. The recombinant expression cassette can be incorporated into a plasmid, chromosome, mitochondrial DNA, plastid DNA, virus, or nucleic acid fragment.

Typically, the recombinant expression cassette portion of an expression vector includes, among other sequences, a nucleic acid sequence to be transcribed and a promoter. In certain embodiments, the expression cassette of the invention comprises polynucleotide sequences that encode bispecific antigen binding molecules of the invention or fragments thereof.

The term "vector" or "expression vector" is synonymous with "expression construct" and refers to a DNA molecule that is used to introduce and direct the expression of a specific gene to which it is operably associated in a target cell. The term includes the vector as a self-replicating nucleic acid structure as well as the vector incorporated into the genome of a host cell into which it has been introduced. The expression vector of the present invention comprises an expression cassette. Expression vectors allow transcription of large amounts of stable mRNA. Once the expression vector is inside the target cell, the ribonucleic acid molecule or protein that is encoded by the gene is produced by the cellular transcription and/or translation machinery. In one embodiment, the expression vector of the invention comprises an expression cassette that comprises polynucleotide sequences that encode bispecific antigen binding molecules of the invention or fragments thereof.

The terms "host cell", "host cell line," and "host cell culture" are used interchangeably and refer to cells into which exogenous nucleic acid has been introduced, including the progeny of such cells. Host cells include "transformants" and "transformed cells," which include the primary transformed cell and progeny derived therefrom without regard to the number of passages. Progeny may not be completely identical in nucleic acid content to a parent cell, but may contain mutations. Mutant progeny that have the same function or biological activity as screened or selected for in the originally transformed cell are included herein. A host cell is any type of cellular system that can be used to generate the bispecific antigen binding molecules of the present invention. Host cells include cultured cells, e.g. mammalian cultured cells, such as CHO cells, BHK cells, NS0 cells, SP2/0 cells, YO myeloma cells, P3X63 mouse myeloma cells, PER cells, PER.C6 cells or hybridoma cells, yeast cells, insect cells, and plant cells, to name only a few, but also cells comprised within a transgenic animal, transgenic plant or cultured plant or animal tissue.

An "effective amount" of an agent refers to the amount that is necessary to result in a physiological change in the cell or tissue to which it is administered.

A "therapeutically effective amount" of an agent, e.g. a pharmaceutical composition, refers to an amount effective, at dosages and for periods of time necessary, to achieve the desired therapeutic or prophylactic result. A therapeutically effective amount of an agent for example eliminates, decreases, delays, minimizes or prevents adverse effects of a disease.

An "individual" or "subject" is a mammal. Mammals include, but are not limited to, domesticated animals (e.g. cows, sheep, cats, dogs, and horses), primates (e.g. humans and non-human primates such as monkeys), rabbits, and rodents (e.g. mice and rats). Particularly, the individual or subject is a human.

The term "pharmaceutical composition" refers to a preparation which is in such form as to permit the biological activity of an active ingredient contained therein to be effective, and which contains no additional components which are unacceptably toxic to a subject to which the formulation would be administered.

A "pharmaceutically acceptable excipient" refers to an ingredient in a pharmaceutical composition, other than an active ingredient, which is nontoxic to a subject. A pharmaceutically acceptable excipient includes, but is not limited to, a buffer, a stabilizer, or a preservative.

The term "package insert" is used to refer to instructions customarily included in commercial packages of therapeutic products, that contain information about the indications, usage, dosage, administration, combination therapy, contraindications and/or warnings concerning the use of such therapeutic products.

As used herein, "treatment" (and grammatical variations thereof such as "treat" or "treating") refers to clinical intervention in an attempt to alter the natural course of the individual being treated, and can be performed either for prophylaxis or during the course of clinical pathology. Desirable effects of treatment include, but are not limited to, preventing occurrence or recurrence of disease, alleviation of symptoms, diminishment of any direct or indirect pathological consequences of the disease, preventing metastasis, decreasing the rate of disease progression, amelioration or palliation of the disease state, and remission or improved prognosis.

In some embodiments, the molecules of the invention are used to delay development of a disease or to slow the progression of a disease.

The term "cancer" as used herein refers to proliferative diseases, such as lymphomas, carcinoma, lymphoma, blastoma, sarcoma, leukemia, lymphocytic leukemias, lung cancer, non-small cell lung (NSCL) cancer, bronchioloalviolar cell lung cancer, bone cancer, pancreatic cancer, skin cancer, cancer of the head or neck, cutaneous or intraocular melanoma, uterine cancer, ovarian cancer, rectal cancer, cancer of the anal region, stomach cancer, gastric cancer, colorectal cancer (CRC), pancreatic cancer, breast cancer, triple-negative breast cancer, uterine cancer, carcinoma of the fallopian tubes, carcinoma of the endometrium, carcinoma of the cervix, carcinoma of the vagina, carcinoma of the vulva, Hodgkin's Disease, cancer of the esophagus, cancer of the small intestine, cancer of the endocrine system, cancer of the thyroid gland, cancer of the parathyroid gland, cancer of the adrenal gland, sarcoma of soft tissue, cancer of the urethra, cancer of the penis, prostate cancer, cancer of the bladder, cancer of the kidney or ureter, renal cell carcinoma, carcinoma of the renal pelvis, mesothelioma, hepatocellular cancer, biliary cancer, neoplasms of the central nervous system (CNS), spinal axis tumors, brain stem glioma, glioblastoma multiforme, astrocytomas, schwanomas, ependymonas, medulloblastomas, meningiomas, squamous cell carcinomas, pituitary adenoma and Ewings sarcoma, melanoma, multiple myeloma, B-cell cancer (lymphoma), chronic lymphocytic leukemia (CLL), acute lymphoblastic leukemia (ALL), hairy cell leukemia, chronic myeloblastic leukemia, including refractory versions of any of the above cancers, or a combination of one or more of the above cancers.

TNF family ligand trimer-containing antigen binding molecules of the invention

The invention provides novel TNF family ligand trimer-containing antigen binding molecules with particularly advantageous properties such as producibility, stability, binding affinity, biological activity, targeting efficiency and reduced toxicity.

In a first aspect, the invention provides a TNF family ligand trimer-containing antigen binding molecule comprising
(a) at least one moiety capable of specific binding to a target cell antigen and
(b) a first and a second polypeptide that are linked to each other by a disulfide bond,
wherein the antigen binding molecule is characterized in that the first polypeptide comprises two ectodomains of a TNF ligand family member or two fragments thereof that are connected to each other by a peptide linker and in that the second polypeptide comprises only one ectodomain of said TNF ligand family member or a fragment thereof.

In a particular aspect, the invention provides a TNF family ligand trimer-containing antigen binding molecule comprising
(a) at least one moiety capable of specific binding to a target cell antigen,
(b) a first and a second polypeptide that are linked to each other by a disulfide bond,
wherein the antigen binding molecule is characterized in that the first polypeptide comprises two ectodomains of a TNF ligand family member or two fragments thereof that are connected to each other by a peptide linker and in that the second polypeptide comprises only one ectodomain of said TNF ligand family member or a fragment thereof, and (c) an Fc domain composed of a first and a second subunit capable of stable association.

In a particular aspect, the TNF family ligand trimer-containing antigen binding molecule comprises (a) at least one moiety capable of specific binding to a target cell antigen and (b) a first and a second polypeptide that are linked to each other by a disulfide bond, wherein the antigen binding molecule is characterized in that the first polypeptide comprises two ectodomains of a TNF ligand family member or two fragments thereof that are connected to each other by a peptide linker and in that the second polypeptide comprises only one ectodomain of said TNF ligand family member or a fragment thereof, wherein the TNF ligand family member is costimulates human T-cell activation.

In another particular aspect, the TNF family ligand trimer-containing antigen binding molecule comprises (a) at least one moiety capable of specific binding to a target cell antigen and (b) a first and a second polypeptide that are linked to each other by a disulfide bond, wherein the antigen binding molecule is characterized in that the first polypeptide comprises two ectodomains of a TNF ligand family member or two fragments thereof that are connected to each other by a peptide linker and in that the second polypeptide comprises only one ectodomain of said TNF ligand family member or a fragment thereof, wherein the ectodomains of a TNF ligand family member are identical in all instances.

In a further aspect, provided is a TNF family ligand trimer-containing antigen binding molecule of claim 1, comprising (a) at least one moiety capable of specific binding to a target cell antigen and (b) a first and a second polypeptide that are linked to each other by a disulfide bond, wherein the antigen binding molecule is characterized in that (i) the first polypeptide contains a CH1 or CL domain and the second polypeptide contains a CL or CH1 domain, respectively, wherein the second polypeptide is linked to the first polypeptide by a disulfide bond between the CH1 and CL domain, and wherein the first polypeptide comprises two ectodomains of a TNF ligand family member or fragments thereof that are connected to each other and to the CH1 or CL domain by a peptide linker and wherein the second polypeptide comprises one ectodomain of said TNF ligand family member or a fragment thereof connected via a peptide linker to the CL or CH1 domain of said polypeptide, or (ii) the first polypeptide contains a CH3 domain and the second polypeptide contains a CH3 domain, respectively, and wherein the first polypeptide comprises two ectodomains of a TNF ligand family member or fragments thereof that are connected to each other and to the C-terminus of the CH3 domain by a peptide linker and wherein the second polypeptide comprises only one ectodomain of said TNF ligand family member or a fragment thereof connected via a peptide linker to C-terminus of the CH3 domain of said polypeptide, or (iii) the first polypeptide contains a VH-CL or a VL-CH1 domain and the second polypeptide contains a VL-CH1 domain or a VH-CL domain, respectively, wherein the second polypeptide is linked to the first polypeptide by a disulfide bond between the CH1 and CL domain, and wherein the first polypeptide comprises two ectodomains of a TNF ligand family member or fragments thereof that are connected to each other and to VH or VL by a peptide linker and wherein the second polypeptide comprises one ectodomain of said TNF ligand family member or a fragment thereof connected via a peptide linker to VL or VH of said polypeptide.

In a particular aspect, the TNF family ligand trimer-containing antigen binding molecule comprises a TNF ligand family member that costimulates human T-cell activation which is selected from 4-1BBL and OX40L. More particularly, the TNF ligand family member is 4-1BBL.

In another aspect, wherein the ectodomain of a TNF ligand family member comprises the amino acid sequence selected from the group consisting of SEQ ID NO:1, SEQ ID NO: 2, SEQ ID NO:3, SEQ ID NO:4, SEQ ID NO:96, SEQ ID NO: 373, SEQ ID NO:374 and SEQ ID NO:375, particularly the amino acid sequence of SEQ ID NO:1 or SEQ ID NO:96. In one aspect, the ectodomain of a TNF ligand family member or fragment thereof comprises the amino acid sequence selected from the group consisting of SEQ ID NO:1, SEQ ID NO: 2, SEQ ID NO:3, SEQ ID NO:4 and SEQ ID NO:96, particularly the amino acid sequence of SEQ ID NO:1 or SEQ ID NO:96. In a particular aspect, the the ectodomain of a TNF ligand family member or fragment thereof comprises the amino acid sequence of SEQ ID NO:96.

In a further aspect, the TNF family ligand trimer-containing antigen binding molecule of the invention comprises (a) at least one moiety capable of specific binding to a target cell antigen and (b) a first and a second polypeptide that are linked to each other by a disulfide bond, wherein the antigen binding molecule is characterized in that the first polypeptide comprises the amino acid sequence selected from the group consisting of SEQ ID NO:5, SEQ ID NO:97, SEQ ID NO:98 and SEQ ID NO:99 and in that the second polypeptide comprises the amino acid sequence selected from the group consisting of SEQ ID NO:1, SEQ ID NO:96, SEQ ID NO:3 and SEQ ID NO:4. In a particular aspect, the first polypeptide comprises the amino acid sequence of SEQ ID NO:97 and the second polypeptide comprises the amino acid sequence of SEQ ID NO:96.

In one aspect, the TNF family ligand trimer-containing antigen binding molecule of the invention comprises (a) at least one moiety capable of specific binding to a target cell antigen and (b) a first and a second polypeptide that are linked to each other by a disulfide bond, wherein the antigen binding molecule is characterized in that the first polypeptide comprises the amino acid sequence of SEQ ID NO:5 and in that the second polypeptide comprises the amino acid sequence of SEQ ID NO:6.

In a further aspect, the TNF family ligand trimer-containing antigen binding molecule of the invention comprises (a) at least one moiety capable of specific binding to a target cell antigen and (b) a first and a second polypeptide that are linked to each other by a disulfide bond, wherein the antigen binding molecule is characterized in that the first polypeptide comprises the amino acid sequence of SEQ ID NO:5 and in that the second polypeptide comprises the amino acid sequence of SEQ ID NO:183.

In yet a further aspect, the TNF family ligand trimer-containing antigen binding molecule of the invention comprises (a) at least one moiety capable of specific binding to a target cell antigen and
(b) a first and a second polypeptide that are linked to each other by a disulfide bond,
wherein the antigen binding molecule is characterized in that the first polypeptide comprises the amino acid sequence of SEQ ID NO:97 and in that the second polypeptide comprises the amino acid sequence of SEQ ID NO:184 or SEQ ID NO:185.

In another aspect, the TNF ligand family member is OX40L. In a particular aspect, provided is TNF family ligand trimer-containing antigen binding molecule, wherein the ectodomain of a TNF ligand family member comprises the amino acid sequence of SEQ ID NO:53 or SEQ ID NO:54, particularly the amino acid sequence of SEQ ID NO:53.

In one aspect, the invention relates to a TNF family ligand trimer-containing antigen binding molecule comprising
(a) at least one moiety capable of specific binding to a target cell antigen and
(b) a first and a second polypeptide that are linked to each other by a disulfide bond,
wherein the antigen binding molecule is characterized in that the first polypeptide comprises the amino acid sequence of SEQ ID NO:371 or SEQ ID:372 and in that the second polypeptide comprises the amino acid sequence of SEQ ID NO:53 or SEQ ID NO:54, respectively.

In one aspect, the TNF family ligand trimer-containing antigen binding molecule of the invention comprises
(a) at least one moiety capable of specific binding to a target cell antigen,
(b) a first polypeptide containing a CH1 or CL domain and a second polypeptide containing a CL or CH1 domain, respectively, wherein the second polypeptide is linked to the first polypeptide by a disulfide bond between the CH1 and CL domain,
and wherein the antigen binding molecule is characterized in that the first polypeptide comprises two ectodomains of a TNF ligand family member or fragments thereof that are connected to each other and to the CH1 or CL domain by a peptide linker and in that the second polypeptide comprises only one ectodomain of said TNF ligand family member or a fragment thereof connected via a peptide linker to the CL or CH1 domain of said polypeptide.

In one aspect, provided is a TNF family ligand trimer-containing antigen binding molecule comprising
(a) at least one moiety capable of specific binding to a target cell antigen,
(b) a first polypeptide containing a CH1 domain and a second polypeptide containing a CL domain, wherein the second polypeptide is linked to the first polypeptide by a disulfide bond between the CH1 and CL domain,
and wherein the antigen binding molecule is characterized in that the first polypeptide comprises two ectodomains of a TNF ligand family member or fragments thereof that are connected to each other and to the CH1 domain by a peptide linker and in that the second polypeptide comprises one ectodomain of said TNF ligand family member or a fragment thereof connected via a peptide linker to the CL domain of said polypeptide.

In another aspect, provided is a TNF family ligand trimer-containing antigen binding molecule comprising
(a) at least one moiety capable of specific binding to a target cell antigen,
(b) a first polypeptide containing a CL domain and a second polypeptide containing a CH1 domain, wherein the second polypeptide is linked to the first polypeptide by a disulfide bond between the CH1 and CL domain,
and wherein the antigen binding molecule is characterized in that the first polypeptide comprises two ectodomains of a TNF ligand family member or fragments thereof that are connected to each other and to the CL domain by a peptide linker and in that the second polypeptide comprises one ectodomain of said TNF ligand family member or a fragment thereof connected via a peptide linker to the CH1 domain of said polypeptide.

In another aspect, the invention provides a TNF family ligand trimer-containing antigen binding molecule comprising
(a) one moiety capable of specific binding to a target cell antigen and
(b) a first and a second polypeptide that are linked to each other by a disulfide bond,
wherein the antigen binding molecule is characterized in that the first polypeptide comprises two ectodomains of a TNF ligand family member or two fragments thereof that are connected to each other by a peptide linker and in that the second polypeptide comprises only one ectodomain of said TNF ligand family member or a fragment thereof.

In yet another aspect, the invention provides a TNF family ligand trimer-containing antigen binding molecule comprising
(a) more than one moiety capable of specific binding to a target cell antigen and
(b) a first and a second polypeptide that are linked to each other by a disulfide bond,
wherein the antigen binding molecule is characterized in that the first polypeptide comprises two ectodomains of a TNF ligand family member or two fragments thereof that are connected to each other by a peptide linker and in that the second polypeptide comprises only one ectodomain of said TNF ligand family member or a fragment thereof connected via a peptide linker to said polypeptide.

In one aspect, the invention provides a TNF family ligand trimer-containing antigen binding molecule comprising
(a) two moities capable of specific binding to a target cell antigen and
(b) a first and a second polypeptide that are linked to each other by a disulfide bond,
wherein the antigen binding molecule is characterized in that the first polypeptide comprises two ectodomains of a TNF ligand family member or two fragments thereof that are connected to each other by a peptide linker and in that the second polypeptide comprises only one ectodomain of said TNF ligand family member or a fragment thereof.

In a particular aspect, provided is a TNF family ligand trimer-containing antigen binding molecule, comprising
(a) at least one moiety capable of specific binding to a target cell antigen, and
(b) a first and a second polypeptide that are linked to each other by a disulfide bond,
wherein the antigen binding molecule is characterized in that the first polypeptide contains a CH3 domain and the second polypeptide contains a CH3 domain, respectively, and wherein the first polypeptide comprises two ectodomains of a TNF ligand family member or fragments thereof that are connected to each other and to the C-terminus of the CH3 domain by a peptide linker and wherein the second polypeptide comprises one ectodomain of said TNF ligand family member or a fragment thereof connected via a peptide linker to C-terminus of the CH3 domain of said polypeptide. Particularly, such TNF family ligand trimer-containing antigen binding molecule comprises two moieties capable of specific binding to a target cell antigen.

In one aspect, the invention provides a TNF family ligand trimer-containing antigen binding molecule comprising
(a) two moities capable of specific binding to a target cell antigen and
(b) a first and a second polypeptide that are linked to each other by a disulfide bond,
wherein the antigen binding molecule is characterized in that the first polypeptide comprises two ectodomains of a TNF ligand family member or two fragments thereof that are connected to each other by a peptide linker and in that the second polypeptide comprises one ectodomain of said TNF ligand family member or a fragment thereof,
wherein the two moieties capable of specific binding to a target cell antigen bind to two different target cell antigens.

In a further aspect, the invention provides a TNF family ligand trimer-containing antigen binding molecule as defined herein before, wherein the moiety capable of specific binding to a target cell antigen is selected from the group consisting of an antibody, an antibody fragment and a scaffold antigen binding protein.

In one aspect, provided is a TNF family ligand trimer-containing antigen binding molecule as described herein before, wherein the moiety capable of specific binding to a target cell antigen is selected from the group consisting of an antibody fragment, a Fab molecule, a crossover Fab molecule, a single chain Fab molecule, a Fv molecule, a scFv molecule, a single domain antibody, an aVH and a scaffold antigen binding protein. In one aspect, the moiety capable of specific binding to a target cell antigen is an aVH or a scaffold antigen binding protein. In one aspect, the moiety capable of specific binding to a target cell antigen is a scaffold antigen binding protein capable of specific binding to a target cell antigen.

In particular, the TNF family ligand trimer-containing antigen binding molecule comprises one or two moieties capable of specific binding to a target cell antigen.

In a particular aspect, provided is a TNF family ligand trimer-containing antigen binding molecule, wherein the moiety capable of specific binding to a target cell antigen is a Fab molecule or a crossover Fab molecule capable of specific binding to a target cell antigen. In particular, the moiety capable of specific binding to a target cell antigen is a Fab capable of specific binding to a target cell antigen.

Furthermore, provided is TNF family ligand trimer-containing antigen binding molecule as described herein, wherein the target cell antigen is selected from the group consisting of Fibroblast Activation Protein (FAP), Melanoma-associated Chondroitin Sulfate Proteoglycan (MCSP), Epidermal Growth Factor Receptor (EGFR), Carcinoembryonic Antigen (CEA), CD19, CD20 and CD33.

In a further aspect, provided is a TNF family ligand trimer-containing antigen binding molecule according to the invention, wherein a peptide comprising two ectodomains of a TNF ligand family member or fragments thereof connected to each other by a first peptide linker is fused at its C-terminus to the CH1 domain of a heavy chain by a second peptide linker and wherein one ectodomain of said TNF ligand family member or a fragment thereof is fused at the its C-terminus to the CL domain on a light chain by a third peptide linker.

In another aspect, provided is a TNF family ligand trimer-containing antigen binding molecule according to the invention, wherein a peptide comprising two ectodomains of a TNF ligand family member or fragments thereof connected to each other by a first peptide linker is fused at its C-terminus to the CL domain of a heavy chain by a second peptide linker and wherein one ectodomain of said TNF ligand family member or a fragment thereof is fused at the its C-terminus to the CH1 domain on a light chain by a third peptide linker.

In a further aspect, the invention is concerned with a TNF family ligand trimer-containing antigen binding molecule according to the invention, wherein a peptide comprising two ectodomains of a TNF ligand family member or fragments thereof connected to each other by a first peptide linker is fused at its C-terminus to the CL domain of a light chain by a second peptide linker and wherein one ectodomain of said TNF ligand family member or a fragment thereof is fused at the its C-terminus to the CH1 domain of the heavy chain by a third peptide linker.

In a particular aspect, the invention relates to a TNF family ligand trimer-containing antigen binding molecule as defined above, wherein the peptide linker is $(G_4S)_2$ (SEQ ID NO:13). In one aspect, the first peptide linker is $(G_4S)_2$ (SEQ ID NO:13), the second peptide linker is GSPGSSSSGS (SEQ ID NO:57) and the third peptide linker is $(G_4S)_2$ (SEQ ID NO:13). In particular, the invention relates to a TNF ligand trimer-containing antigen binding molecule as defined above, wherein the first peptide linker is $(G_4S)_2$ (SEQ ID NO:13), the second peptide linker is $(G_4S)_2$ (SEQ ID NO:13), and the third peptide linker is $(G_4S)_2$ (SEQ ID NO:13).

In another aspect, the TNF family ligand trimer-containing antigen binding molecule as defined herein before comprises an Fc domain composed of a first and a second subunit capable of stable association.

In particular, the TNF family ligand trimer-containing antigen binding molecule of the invention comprises (a) a Fab molecule capable of specific binding to a target cell antigen, wherein the Fab heavy chain is fused at the C-terminus to the N-terminus of a CH2 domain in the Fc domain and (c) an Fc domain composed of a first and a second subunit capable of stable association.

In a further aspect, the Fc domain is an IgG, particularly an IgG1 Fc domain or an IgG4 Fc domain. More particularly, the Fc domain is an IgG1 Fc domain. In a particular aspect, the Fc domain comprises a modification promoting the association of the first and second subunit of the Fc domain.

Fc domain modifications reducing Fc receptor binding and/or effector function

The Fc domain of the TNF family ligand trimer-containing antigen binding molecules of the invention consists of a pair of polypeptide chains comprising heavy chain domains of an immunoglobulin molecule. For example, the Fc domain of an immunoglobulin G (IgG) molecule is a dimer, each subunit of which comprises the CH2 and CH3 IgG heavy chain constant domains. The two subunits of the Fc domain are capable of stable association with each other.

The Fc domain confers favorable pharmacokinetic properties to the antigen binding molecules of the invention, including a long serum half-life which contributes to good accumulation in the target tissue and a favorable tissue-blood distribution ratio. At the same time it may, however, lead to undesirable targeting of the bispecific antibodies of the invention to cells expressing Fc receptors rather than to the preferred antigen-bearing cells. Accordingly, in particular aspects, the Fc domain of the TNF family ligand trimer-containing antigen binding molecule of the invention exhibits reduced binding affinity to an Fc receptor and/or reduced effector function, as compared to a native IgG1 Fc domain. In one aspect, the Fc does not substantially bind to an Fc receptor and/or does not induce effector function. In a particular aspect the Fc receptor is an Fcγ receptor. In one aspect, the Fc receptor is a human Fc receptor.

In a specific aspect, the Fc receptor is an activating human Fcγ receptor, more specifically human FcγRIIIa, FcγRI or FcγRIIa, most specifically human FcγRIIIa. In one aspect, the Fc domain does not induce effector function. The reduced effector function can include, but is not limited to, one or more of the following: reduced complement dependent cytotoxicity (CDC), reduced antibody-dependent cell-mediated cytotoxicity (ADCC), reduced antibody-dependent cellular phagocytosis (ADCP), reduced cytokine secretion, reduced immune complex-mediated antigen uptake by antigen-presenting cells, reduced binding to NK cells, reduced binding to macrophages, reduced binding to monocytes, reduced binding to polymorphonuclear cells, reduced direct signaling inducing apoptosis, reduced dendritic cell maturation, or reduced T cell priming.

In certain aspects, one or more amino acid modifications may be introduced into the Fc region of a TNF family ligand trimer-containing antigen binding molecule provided herein, thereby generating an Fc region variant. The Fc region variant may comprise a human Fc region sequence (e.g., a human IgG1, IgG2, IgG3 or IgG4 Fc region) comprising an amino acid modification (e.g. a substitution) at one or more amino acid positions.

In a particular aspect, the invention provides a TNF family ligand trimer-containing antigen binding molecule comprising
(a) at least one moiety capable of specific binding to a target cell antigen,
(b) a first and a second polypeptide that are linked to each other by a disulfide bond,
wherein the antigen binding molecule is characterized in that the first polypeptide comprises two ectodomains of a TNF ligand family member or two fragments thereof that are connected to each other by a peptide linker and in that the second polypeptide comprises only one ectodomain of said TNF ligand family member or a fragment thereof, and
(c) an Fc domain composed of a first and a second subunit capable of stable association, wherein the Fc domain comprises one or more amino acid substitution that reduces binding to an Fc receptor, in particular towards Fcγ receptor.

In one aspect, the Fc domain of the TNF family ligand trimer-containing antigen binding molecule of the invention comprises one or more amino acid mutation that reduces the binding affinity of the Fc domain to an Fc receptor and/or effector function. Typically, the same one or more amino acid mutation is present in each of the two subunits of the Fc domain. In particular, the Fc domain comprises an amino acid substitution at a position of E233, L234, L235, N297, P331 and P329 (EU numbering). In particular, the Fc domain comprises amino acid substitutions at positions 234 and 235 (EU numbering) and/or 329 (EU numbering) of the IgG heavy chains. More particularly, provided is a trimeric TNF family ligand-containing antigen binding molecule according to the invention which comprises an Fc domain with the amino acid substitutions L234A, L235A and P329G ("P329G LALA", EU numbering) in the IgG heavy chains. The amino acid substitutions L234A and L235A refer to the so-called LALA mutation. The "P329G LALA" combination of amino acid substitutions almost completely abolishes Fcγ receptor binding of a human IgG1 Fc domain and is described in International Patent Appl. Publ. No. WO 2012/130831 A1 which also describes methods of preparing such mutant Fc domains and methods for determining its properties such as Fc receptor binding or effector functions. "EU numbering" refers to the numbering according to EU index of Kabat et al, Sequences of Proteins of Immunological Interest, 5th Ed. Public Health Service, National Institutes of Health, Bethesda, Md., 1991.

Fc domains with reduced Fc receptor binding and/or effector function also include those with substitution of one or more of Fc domain residues 238, 265, 269, 270, 297, 327 and 329 (U.S. Pat. No. 6,737,056). Such Fc mutants include Fc mutants with substitutions at two or more of amino acid positions 265, 269, 270, 297 and 327, including the so-called "DANA" Fc mutant with substitution of residues 265 and 297 to alanine (U.S. Pat. No. 7,332,581).

In another aspect, the Fc domain is an IgG4 Fc domain. IgG4 antibodies exhibit reduced binding affinity to Fc receptors and reduced effector functions as compared to IgG1 antibodies. In a more specific aspect, the Fc domain is an IgG4 Fc domain comprising an amino acid substitution at position 5228 (Kabat numbering), particularly the amino acid substitution S228P. In a more specific aspect, the Fc domain is an IgG4 Fc domain comprising amino acid substitutions L235E and S228P and P329G (EU numbering). Such IgG4 Fc domain mutants and their Fcγ receptor binding properties are also described in WO 2012/130831.

Mutant Fc domains can be prepared by amino acid deletion, substitution, insertion or modification using genetic or chemical methods well known in the art. Genetic methods may include site-specific mutagenesis of the encoding DNA sequence, PCR, gene synthesis, and the like. The correct nucleotide changes can be verified for example by sequencing.

Binding to Fc receptors can be easily determined e.g. by ELISA, or by Surface Plasmon Resonance (SPR) using standard instrumentation such as a BIACORE® instrument (GE Healthcare), and Fc receptors such as may be obtained by recombinant expression. A suitable such binding assay is described herein. Alternatively, binding affinity of Fc domains or cell activating bispecific antigen binding molecules comprising an Fc domain for Fc receptors may be evaluated using cell lines known to express particular Fc receptors, such as human NK cells expressing FcγIIIa receptor.

Effector function of an Fc domain, or bispecific antibodies of the invention comprising an Fc domain, can be measured by methods known in the art. A suitable assay for measuring ADCC is described herein. Other examples of in vitro assays to assess ADCC activity of a molecule of interest are described in U.S. Pat. No. 5,500,362; Hellstrom et al. Proc Natl Acad Sci USA 83, 7059-7063 (1986) and Hellstrom et al., Proc Natl Acad Sci USA 82, 1499-1502 (1985); U.S. Pat. No. 5,821,337; Bruggemann et al., J Exp Med 166, 1351-1361 (1987). Alternatively, non-radioactive assays methods may be employed (see, for example, ACTI™ non-radioactive cytotoxicity assay for flow cytometry (CellTechnology, Inc. Mountain View, Calif.); and CytoTox 96® non-radioactive cytotoxicity assay (Promega, Madison, Wis.)). Useful effector cells for such assays include peripheral blood mononuclear cells (PBMC) and Natural Killer (NK) cells. Alternatively, or additionally, ADCC activity of the molecule of interest may be assessed in vivo, e.g. in a animal model such as that disclosed in Clynes et al., Proc Natl Acad Sci USA 95, 652-656 (1998).

In some embodiments, binding of the Fc domain to a complement component, specifically to C1q, is reduced. Accordingly, in some embodiments wherein the Fc domain is engineered to have reduced effector function, said reduced effector function includes reduced CDC. C1q binding assays may be carried out to determine whether the bispecific antibodies of the invention is able to bind C1q and hence has CDC activity. See e.g., C1q and C3c binding ELISA in WO 2006/029879 and WO 2005/100402. To assess complement activation, a CDC assay may be performed (see, for example, Gazzano-Santoro et al., J Immunol Methods 202, 163 (1996); Cragg et al., Blood 101, 1045-1052 (2003); and Cragg and Glennie, Blood 103, 2738-2743 (2004)).

In a particular aspect, the Fc domain comprises a modification promoting the association of the first and second subunit of the Fc domain.

Fc domain modifications promoting heterodimerization

In one aspect, the TNF family ligand trimer-containing antigen binding molecules of the invention comprise (a) at least one moiety capable of specific binding to a target cell antigen, (b) a first and a second polypeptide that are linked to each other by a disulfide bond, wherein the antigen binding molecule is characterized in that the first polypeptide comprises two ectodomains of a TNF ligand family member or two fragments thereof that are connected to each other by a peptide linker and in that the second polypeptide comprises only one ectodomain of said TNF ligand family member or a fragment thereof, and (c) an Fc domain composed of a first and a second subunit capable of stable association, wherein the Fc domain comprises one or more amino acid substitution that reduces binding to an Fc receptor, in particular towards Fcγ receptor. Thus, they comprise different moieties, fused to one or the other of the two subunits of the Fc domain that are typically comprised in two non-identical polypetide chains ("heavy chains"). Recombinant co-expression of these polypeptides and subsequent dimerization leads to several possible combinations of the two polypeptides. To improve the yield and purity of the TNF family ligand trimer-containing antigen binding molecules in recombinant production, it will thus be advantageous to introduce in the Fc domain of the TNF family ligand trimer-containing antigen binding molecules of the invention a modification promoting the association of the desired polypeptides.

Accordingly, the Fc domain of the TNF family ligand trimer-containing antigen binding molecules of the invention comprises a modification promoting the association of the first and the second subunit of the Fc domain. The site of most extensive protein-protein interaction between the two subunits of a human IgG Fc domain is in the CH3 domain of the Fc domain. Thus, said modification is particularly in the CH3 domain of the Fc domain.

In a specific aspect, said modification is a so-called "knob-into-hole" modification, comprising a "knob" modification in one of the two subunits of the Fc domain and a "hole" modification in the other one of the two subunits of the Fc domain. Thus, in a particular aspect, the invention relates to a TNF family ligand trimer-containing antigen binding molecule as described herein before which comprises an IgG molecule, wherein the Fc part of the first heavy chain comprises a first dimerization module and the Fc part of the second heavy chain comprises a second dimerization module allowing a heterodimerization of the two heavy chains of the IgG molecule and the first dimerization module comprises knobs and the second dimerization module comprises holes according to the knob into hole technology.

The knob-into-hole technology is described e.g. in U.S. Pat. Nos. 5,731,168; 7,695,936; Ridgway et al., Prot Eng 9, 617-621 (1996) and Carter, J Immunol Meth 248, 7-15 (2001). Generally, the method involves introducing a protuberance ("knob") at the interface of a first polypeptide and a corresponding cavity ("hole") in the interface of a second polypeptide, such that the protuberance can be positioned in the cavity so as to promote heterodimer formation and hinder homodimer formation. Protuberances are constructed by replacing small amino acid side chains from the interface of the first polypeptide with larger side chains (e.g. tyrosine or tryptophan). Compensatory cavities of identical or similar size to the protuberances are created in the interface of the second polypeptide by replacing large amino acid side chains with smaller ones (e.g. alanine or threonine).

Accordingly, in a particular aspect, in the CH3 domain of the first subunit of the Fc domain of the TNF family ligand trimer-containing antigen binding molecules of the invention an amino acid residue is replaced with an amino acid residue having a larger side chain volume, thereby generating a protuberance within the CH3 domain of the first subunit which is positionable in a cavity within the CH3 domain of the second subunit, and in the CH3 domain of the second subunit of the Fc domain an amino acid residue is replaced with an amino acid residue having a smaller side chain volume, thereby generating a cavity within the CH3 domain of the second subunit within which the protuberance within the CH3 domain of the first subunit is positionable.

The protuberance and cavity can be made by altering the nucleic acid encoding the polypeptides, e.g. by site-specific mutagenesis, or by peptide synthesis.

In a specific aspect, in the CH3 domain of the first subunit of the Fc domain the threonine residue at position 366 is replaced with a tryptophan residue (T366W), and in the CH3 domain of the second subunit of the Fc domain the tyrosine residue at position 407 is replaced with a valine residue (Y407V). More particularly, in the second subunit of the Fc domain additionally the threonine residue at position 366 is replaced with a serine residue (T366S) and the leucine residue at position 368 is replaced with an alanine residue (L368A). More particularly, in the first subunit of the Fc domain additionally the serine residue at position 354 is replaced with a cysteine residue (S354C), and in the second subunit of the Fc domain additionally the tyrosine residue at position 349 is replaced by a cysteine residue (Y349C). The introduction of these two cysteine residues results in the formation of a disulfide bridge between the two subunits of the Fc domain. The disulfide bridge further stabilizes the dimer (Carter, J Immunol Methods 248, 7-15 (2001)).

In an alternative aspect, a modification promoting association of the first and the second subunit of the Fc domain comprises a modification mediating electrostatic steering effects, e.g. as described in PCT publication WO 2009/089004. Generally, this method involves replacement of one or more amino acid residues at the interface of the two Fc domain subunits by charged amino acid residues so that homodimer formation becomes electrostatically unfavorable but heterodimerization electrostatically favorable.

Modifications in the CH1/CL Domains

To further improve correct pairing, the TNF family ligand trimer-containing antigen binding molecules can contain different charged amino acid substitutions (so-called "charged residues"). These modifications are introduced in the crossed or non-crossed CH1 and CL domains. In a particular aspect, the invention relates to a TNF family ligand trimer-containing antigen binding molecule, wherein in one of CL domains the amino acid at position 123 (EU numbering) has been replaced by arginine (R) and the amino acid at position 124 (EU numbering) has been substituted by lysine (K) and wherein in one of the CH1 domains the the amino acids at position 147 (EU numbering) and at position 213 (EU numbering) have been substituted by glutamic acid (E).

More particularly, the invention relates to a TNF family ligand trimer-containing antigen binding molecule, wherein in the CL domain adjacent to the TNF ligand family member the amino acid at position 123 (EU numbering) has been replaced by arginine (R) and the amino acid at position 124 (EU numbering) has been substituted by lysine (K), and wherein in the CH1 domain adjacent to the TNF ligand family member the amino acids at position 147 (EU numbering) and at position 213 (EU numbering) have been substituted by glutamic acid (E).

Particular TNF family ligand trimer-containing antigen binding molecules

In another aspect, the invention provides a TNF family ligand trimer-containing antigen binding molecule, wherein the antigen binding molecule comprises
a first heavy chain and a first light chain, both comprising a Fab molecule capable of specific binding to a target cell antigen,
a first peptide comprising two ectodomains of a TNF ligand family member or fragments thereof connected to each other by a first peptide linker fused at its C-terminus by a second peptide linker to a second heavy or light chain,
and a second peptide comprising one ectodomain of said TNF ligand family member fused at its C-terminus by a third peptide linker to a second light or heavy chain, respectively.

In a further aspect, provided is a TNF family ligand trimer-containing antigen binding molecule, wherein the first peptide comprising two ectodomains of a TNF ligand family member or fragments thereof connected to each other by a first peptide linker is fused at its C-terminus by a second peptide linker to a CH1 domain that is part of a heavy chain, and the second peptide comprising one ectodomain of said TNF ligand family member or a fragment thereof is fused at its C-terminus by a third peptide linker to a CL domain that is part of a light chain.

In yet another aspect, provided is a TNF family ligand trimer-containing antigen binding molecule, wherein the first peptide comprising two ectodomains of a TNF ligand family member or fragments thereof connected to each other by a first peptide linker is fused at its C-terminus by a second peptide linker to a CL domain that is part of a heavy chain, and the second peptide comprising one ectodomain of said TNF ligand family member or a fragment thereof that is fused at its C-terminus by a third peptide linker to a CH1 domain that is part of a light chain.

In a further aspect, provided is a TNF family ligand trimer-containing antigen binding molecule, wherein the first peptide comprising two ectodomains of a TNF ligand family member or fragments thereof connected to each other by a first peptide linker is fused at its C-terminus by a second peptide linker to a VH domain that is part of a heavy chain, and the second peptide comprising one ectodomain of said TNF ligand family member or a fragment thereof is fused at its C-terminus by a third peptide linker to a VL domain that is part of a light chain.

In one aspect, the invention provides a TNF family ligand trimer-containing antigen binding molecule of claims 21 to 23, wherein in the CL domain adjacent to the TNF ligand family member the amino acid at position 123 (EU numbering) has been replaced by arginine (R) and the amino acid at position 124 (EU numbering) has been substituted by lysine (K), and wherein in the CH1 domain adjacent to the TNF ligand family member the amino acids at position 147 (EU numbering) and at position 213 (EU numbering) have been substituted by glutamic acid (E). These modifications lead to so-called charged residues with advantageaous properties that avoid undesired effects such as for example mispairing.

Furthermore, provided is TNF family ligand trimer-containing antigen binding molecule as described herein, wherein the target cell antigen is selected from the group consisting of Fibroblast Activation Protein (FAP), Melanoma-associated Chondroitin Sulfate Proteoglycan (MCSP), Epidermal Growth Factor Receptor (EGFR), Carcinoembryonic Antigen (CEA), CD19, CD20 and CD33.

TNF family ligand trimer-containing antigen binding molecules, wherein the target cell antigen is FAP In a particular aspect, provided is a TNF family ligand trimer-containing antigen binding molecule, wherein the target cell antigen is Fibroblast Activation Protein (FAP).

In one aspect, the invention provides a TNF family ligand trimer-containing antigen binding molecule, wherein the moiety capable of specific binding to FAP comprises a VH domain comprising (i) CDR-H1 comprising the amino acid sequence of SEQ ID NO:7 or SEQ ID NO:100, (ii) CDR-H2 comprising the amino acid sequence of SEQ ID NO:8 or SEQ ID NO:101, and (iii) CDR-H3 comprising the amino acid sequence of SEQ ID NO:9 or SEQ ID NO:102, and a VL domain comprising (iv) CDR-L1 comprising the amino acid sequence of SEQ ID NO:10 or SEQ ID NO:103, (v) CDR-L2 comprising the amino acid sequence of SEQ ID NO:11 or SEQ ID NO:104, and (vi) CDR-L3 comprising the amino acid sequence of SEQ ID NO:12 or SEQ ID NO:105.

In a particular aspect, provided is a TNF family ligand trimer-containing antigen binding molecule of the invention, wherein the moiety capable of specific binding to a target cell antigen is a Fab molecule capable of specific binding to FAP and comprises a VH domain comprising (i) CDR-H1 comprising the amino acid sequence of SEQ ID NO:7, (ii) CDR-H2 comprising the amino acid sequence of SEQ ID NO:8 and (iii) CDR-H3 comprising the amino acid sequence of SEQ ID NO:9, and a VL domain comprising (iv) CDR-L1 comprising the amino acid sequence of SEQ ID NO:10, (v) CDR-L2 comprising the amino acid sequence of SEQ ID NO:11 and (vi) CDR-L3 comprising the amino acid sequence of SEQ ID NO:12.

In another aspect, provided is a TNF family ligand trimer-containing antigen binding molecule of the invention, wherein the moiety capable of specific binding to a target cell antigen is a Fab molecule capable of specific binding to FAP and comprises a VH domain comprising (i) CDR-H1 comprising the amino acid sequence of SEQ ID NO:100, (ii) CDR-H2 comprising the amino acid sequence of SEQ ID NO:101 and (iii) CDR-H3 comprising the amino acid sequence of SEQ ID NO:102, and a VL domain comprising (iv) CDR-L1 comprising the amino acid sequence of SEQ ID NO:103, (v) CDR-L2 comprising the amino acid sequence of SEQ ID NO:104 and (vi) CDR-L3 comprising the amino acid sequence of SEQ ID NO:105.

In a further aspect, the moiety capable of specific binding to FAP comprises a heavy chain variable region comprising an amino acid sequence that is at least about 95%, 96%, 97%, 98%, 99% or 100% identical to the amino acid sequence of SEQ ID NO:16 and a light chain variable region comprising an amino acid sequence that is at least about 95%, 96%, 97%, 98%, 99% or 100% identical to the amino acid sequence of SEQ ID NO:17.

In another aspect, the moiety capable of specific binding to FAP comprises a heavy chain variable region comprising an amino acid sequence that is at least about 95%, 96%, 97%, 98%, 99% or 100% identical to the amino acid sequence of SEQ ID NO:106 and a light chain variable region comprising an amino acid sequence that is at least about 95%, 96%, 97%, 98%, 99% or 100% identical to the amino acid sequence of SEQ ID NO:107.

In one aspect, the moiety capable of specific binding to FAP comprises a variable heavy chain comprising an amino acid sequence of SEQ ID NO:16 and a variable light chain comprising an amino acid sequence of SEQ ID NO:17 or a variable heavy chain comprising an amino acid sequence of SEQ ID NO:106 and a variable light chain comprising an amino acid sequence of SEQ ID NO:107.

In a particular aspect, the moiety capable of specific binding to FAP comprises a heavy chain variable region comprising the amino acid sequence of SEQ ID NO:16 and a light chain variable region comprising the amino acid sequence of SEQ ID NO:17. In another particular aspect, the moiety capable of specific binding to FAP comprises a heavy chain variable region comprising the amino acid sequence of SEQ ID NO:106 and a light chain variable region comprising the amino acid sequence of SEQ ID NO:107. In a specific aspect, the moiety capable of specific binding to FAP comprises a VH domain consisting of amino acid sequence of SEQ ID NO:106 and a VL domain consisting of the amino acid sequence of SEQ ID NO:107.

In a further aspect, the TNF family ligand trimer-containing antigen binding molecule of the invention comprises
(a) at least one moiety capable of specific binding to a target cell antigen comprising a heavy chain variable region comprising the amino acid sequence of SEQ ID NO:16 and a light chain variable region comprising the amino acid sequence of SEQ ID NO:17, and
(b) a first and a second polypeptide that are linked to each other by a disulfide bond,
wherein the antigen binding molecule is characterized in that the first polypeptide comprises the amino acid sequence selected from the group consisting of SEQ ID NO:5, SEQ ID NO:97, SEQ ID NO:98 and SEQ ID NO:99 and in that the second polypeptide comprises the amino acid sequence selected from the group consisting of SEQ ID NO:1, SEQ ID NO:96, SEQ ID NO:3 and SEQ ID NO:4.

In a particular aspect, the TNF family ligand trimer-containing antigen binding molecule of the invention comprises
(a) at least one moiety capable of specific binding to a target cell antigen comprising a heavy chain variable region comprising the amino acid sequence of SEQ ID NO:16 and a light chain variable region comprising the amino acid sequence of SEQ ID NO:17, and
(b) a first and a second polypeptide that are linked to each other by a disulfide bond,
wherein the antigen binding molecule is characterized in that the first polypeptide comprises the the amino acid sequence of SEQ ID NO:97 and the second polypeptide comprises the amino acid sequence of SEQ ID NO:96.

In another aspect, the TNF family ligand trimer-containing antigen binding molecule of the invention comprises
(a) at least one moiety capable of specific binding to a target cell antigen comprising a heavy chain variable region comprising the amino acid sequence of SEQ ID NO:106 and a light chain variable region comprising the amino acid sequence of SEQ ID NO:107, and
(b) a first and a second polypeptide that are linked to each other by a disulfide bond,
wherein the antigen binding molecule is characterized in that the first polypeptide comprises the amino acid sequence selected from the group consisting of SEQ ID NO:5, SEQ ID NO:97, SEQ ID NO:98 and SEQ ID NO:99 and in that the second polypeptide comprises the amino acid sequence selected from the group consisting of SEQ ID NO:1, SEQ ID NO:96, SEQ ID NO:3 and SEQ ID NO:4.

In a particular aspect, the TNF family ligand trimer-containing antigen binding molecule of the invention comprises
(a) at least one moiety capable of specific binding to a target cell antigen comprising a heavy chain variable region comprising the amino acid sequence of SEQ ID NO:106 and a light chain variable region comprising the amino acid sequence of SEQ ID NO:107, and
(b) a first and a second polypeptide that are linked to each other by a disulfide bond,
wherein the antigen binding molecule is characterized in that the first polypeptide comprises the the amino acid sequence of SEQ ID NO:97 and the second polypeptide comprises the amino acid sequence of SEQ ID NO:96.

In another aspect, provided is a TNF family ligand trimer-containing antigen binding molecule, wherein the antigen binding molecule comprises
a first heavy chain and a first light chain, both comprising a Fab molecule capable of specific binding to a target cell antigen,
a second heavy chain comprising two ectodomains of a TNF ligand family member or fragments thereof connected to each other by a first peptide linker that is fused at its C-terminus by a second peptide linker to a CH1 domain, and a second light chain comprising one ectodomain of said TNF ligand family member or a fragment thereof is fused at its C-terminus by a third peptide linker to a CL domain, and wherein the antigen binding molecule comprises
(i) a first heavy chain comprising the VH domain comprising the amino acid sequence of SEQ ID NO:16 and a first light chain comprising the VL domain comprising the amino acid sequence of SEQ ID NO:17 or
a first heavy chain comprising the VH domain comprising the amino acid sequence of SEQ ID NO:106 and a first light chain comprising the VL domain comprising the amino acid sequence of SEQ ID NO:107,
(ii) a second heavy chain comprising the amino acid sequence selected from the group consisting of SEQ ID NO:14, SEQ ID NO:108, SEQ ID NO:111 and SEQ ID NO:113, and
(iii) a second light chain comprising the amino acid sequence of SEQ ID NO:15, SEQ ID NO:109, SEQ ID NO:110, SEQ ID NO:112 and SEQ ID NO:114.

In a further particular aspect, provided is a TNF family ligand trimer-containing antigen binding molecule, and wherein the antigen binding molecule comprises
a first heavy chain and a first light chain, both comprising a Fab molecule capable of specific binding to a target cell antigen,
a second heavy chain comprising two ectodomains of a TNF ligand family member or fragments thereof connected to each other by a first peptide linker is fused at its C-terminus by a second peptide linker to a CL domain, and a second light chain comprising one ectodomain of said TNF ligand family member or a fragment thereof that is fused at its C-terminus by a third peptide linker to a CH1 domain, and wherein the molecule comprises
(i) a first heavy chain comprising the VH domain comprising the amino acid sequence of SEQ ID NO:16 and a first light chain comprising the VL domain comprising the amino acid sequence of SEQ ID NO:17 or
a first heavy chain comprising the VH domain comprising the amino acid sequence of SEQ ID NO:106 and a first light chain comprising the VL domain comprising the amino acid sequence of SEQ ID NO:107, (ii) a second heavy chain comprising the amino acid sequence selected from the group consisting of SEQ ID NO:115, SEQ ID NO:117, SEQ ID NO:119 and SEQ ID NO:173, and (iii) a second light chain comprising the amino acid sequence selected from the group consisting of SEQ ID NO:116, SEQ ID NO:118, SEQ ID NO:120 and SEQ ID NO:174.

More particularly, provided is a TNF family ligand trimer-containing antigen binding molecule comprising
(a) a first heavy chain and a first light chain, both comprising a Fab molecule capable of specific binding to a target cell antigen, wherein the first heavy chain comprises the VH domain comprising the amino acid sequence of SEQ ID NO:106 and the first light chain comprises the VL domain comprising the amino acid sequence of SEQ ID NO:107, and
(b) a second heavy chain comprising two ectodomains of a TNF ligand family member or fragments thereof connected to each other by a first peptide linker is fused at its C-terminus by a second peptide linker to a CL domain, and a second light chain comprising one ectodomain of said TNF ligand family member or a fragment thereof that is fused at its C-terminus by a third peptide linker to a CH1 domain, wherein the second heavy chain comprises the amino acid sequence of SEQ ID NO:119 or SEQ ID NO:173, and the second light chain comprises the amino acid sequence of SEQ ID NO:120 or SEQ ID NO:174. In particular, the second heavy chain comprises the amino acid sequence of SEQ ID NO:119 and the second light chain comprises the amino acid sequence of SEQ ID NO:120.

Furthermore, the invention provides a TNF family ligand trimer-containing antigen binding molecule, comprising
(a) at least one moiety capable of specific binding to a target cell antigen, and
(b) a first and a second polypeptide that are linked to each other by a disulfide bond,
wherein the antigen binding molecule is characterized in that the first polypeptide contains a CH3 domain and the second polypeptide contains a CH3 domain, respectively, and wherein the first polypeptide comprises two ectodomains of a TNF ligand family member or fragments thereof that are connected to each other and to the C-terminus of the CH3 domain by a peptide linker and wherein the second polypeptide comprises one ectodomain of said TNF ligand family member or a fragment thereof connected via a peptide linker to C-terminus of the CH3 domain of said polypeptide.

In a particular aspect, such a TNF family ligand trimer-containing antigen binding molecule comprises two moieties capable of specific binding to a target cell antigen.

More particular, such TNF family ligand trimer-containing antigen binding molecule comprises
(i) a first heavy chain comprising the amino acid sequence of SEQ ID NO:121, a second heavy chain comprising the amino acid sequence of SEQ ID NO:122, and two light chains comprising the amino acid sequence of SEQ ID NO:19, or
(ii) a first heavy chain comprising the amino acid sequence of SEQ ID NO:123, a second heavy chain comprising the amino acid sequence of SEQ ID NO:124, and two light chains comprising the amino acid sequence of SEQ ID NO:125, or
(iii) a first heavy chain comprising the amino acid sequence of SEQ ID NO:126, a second heavy chain comprising the amino acid sequence of SEQ ID NO:127, and two light chains comprising the amino acid sequence of SEQ ID NO:125.

In a further aspect, the invention relates to a TNF family ligand trimer-containing antigen binding molecule, selected from the group consisting of:
a) a molecule comprising a first heavy chain comprising the amino acid sequence of SEQ ID NO:18, a first light chain comprising the amino acid sequence of SEQ ID NO:19, a second heavy chain comprising the amino acid sequence of SEQ ID NO:14 and a second light chain comprising the amino acid sequence of SEQ ID NO:15;
b) a molecule comprising a first heavy chain comprising the amino acid sequence of SEQ ID NO:18, a first light chain comprising the amino acid sequence of SEQ ID NO:19, a second heavy chain comprising the amino acid sequence of SEQ ID NO:115 and a second light chain comprising the amino acid sequence of SEQ ID NO:116;
c) a molecule comprising a first heavy chain comprising the amino acid sequence of SEQ ID NO:135, a first light chain comprising the amino acid sequence of SEQ ID NO:136, a second heavy chain comprising the amino acid sequence of SEQ ID NO:108 and a second light chain comprising the amino acid sequence of SEQ ID NO:109;
d) a molecule comprising a first heavy chain comprising the amino acid sequence of SEQ ID NO:18, a first light chain comprising the amino acid sequence of SEQ ID NO:19, a second heavy chain comprising the amino acid sequence of SEQ ID NO:139 and a second light chain comprising the amino acid sequence of SEQ ID NO:140;
e) a molecule comprising two light chains comprising the amino acid sequence of SEQ ID NO:19, a first heavy chain comprising the amino acid sequence of SEQ ID NO:121 and a second heavy chain comprising the amino acid sequence of SEQ ID NO:122;
f) a molecule comprising a first heavy chain comprising the amino acid sequence of SEQ ID NO:18, a first light chain comprising the amino acid sequence of SEQ ID NO:19, a second heavy chain comprising the amino acid sequence of SEQ ID NO:108 and a second light chain comprising the amino acid sequence of SEQ ID NO:110;
g) a molecule comprising a first heavy chain comprising the amino acid sequence of SEQ ID NO:145, a first light chain comprising the amino acid sequence of SEQ ID NO:19, a second heavy chain comprising the amino acid sequence of SEQ ID NO:115 and a second light chain comprising the amino acid sequence of SEQ ID NO:116;
h) a molecule comprising a first heavy chain comprising the amino acid sequence of SEQ ID NO:18, a first light chain comprising the amino acid sequence of SEQ ID NO:19, a second heavy chain comprising the amino acid sequence of SEQ ID NO:148 and a second light chain comprising the amino acid sequence of SEQ ID NO:149;
i) a molecule comprising a first heavy chain comprising the amino acid sequence of SEQ ID NO:18, a first light chain comprising the amino acid sequence of SEQ ID NO:19, a second heavy chain comprising the amino acid sequence of SEQ ID NO:111 and a second light chain comprising the amino acid sequence of SEQ ID NO:112; and
j) a molecule comprising a first heavy chain comprising the amino acid sequence of SEQ ID NO:18, a first light chain comprising the amino acid sequence of SEQ ID NO:19, a second heavy chain comprising the amino acid sequence of SEQ ID NO:113 and a second light chain comprising the amino acid sequence of SEQ ID NO:114.

In another aspect, the invention relates to a TNF family ligand trimer-containing antigen binding molecule, selected from the group consisting of:

a) a molecule comprising a first heavy chain comprising the amino acid sequence of SEQ ID NO:164, a first light chain comprising the amino acid sequence of SEQ ID NO:125, a second heavy chain comprising the amino acid sequence of SEQ ID NO:115 and a second light chain comprising the amino acid sequence of SEQ ID NO:116;

b) a molecule comprising a first heavy chain comprising the amino acid sequence of SEQ ID NO:164, a first light chain comprising the amino acid sequence of SEQ ID NO:125, a second heavy chain comprising the amino acid sequence of SEQ ID NO:117 and a second light chain comprising the amino acid sequence of SEQ ID NO:118;

c) a molecule comprising two light chains comprising the amino acid sequence of SEQ ID NO:125, a first heavy chain comprising the amino acid sequence of SEQ ID NO:123 and a second heavy chain comprising the amino acid sequence of SEQ ID NO:124;

d) a molecule comprising a first heavy chain comprising the amino acid sequence of SEQ ID NO:164, a first light chain comprising the amino acid sequence of SEQ ID NO:125, a second heavy chain comprising the amino acid sequence of SEQ ID NO:119 and a second light chain comprising the amino acid sequence of SEQ ID NO:120;

e) a molecule comprising a first heavy chain comprising the amino acid sequence of SEQ ID NO:164, a first light chain comprising the amino acid sequence of SEQ ID NO:125, a second heavy chain comprising the amino acid sequence of SEQ ID NO:173 and a second light chain comprising the amino acid sequence of SEQ ID NO:174; and f) a molecule comprising two light chains comprising the amino acid sequence of SEQ ID NO:125, a first heavy chain comprising the amino acid sequence of SEQ ID NO:126 and a second heavy chain comprising the amino acid sequence of SEQ ID NO:127.

In particular, the invention provides a TNF family ligand trimer-containing antigen binding molecule comprising a first heavy chain comprising the amino acid sequence of SEQ ID NO:164, a first light chain comprising the amino acid sequence of SEQ ID NO:125, a second heavy chain comprising the amino acid sequence of SEQ ID NO:119 and a second light chain comprising the amino acid sequence of SEQ ID NO:120.

In another aspect, provided is a TNF family ligand trimer-containing antigen binding molecule, wherein the TNF ligand family member is OX40L and wherein the target cell antigen is Fibroblast Activation Protein (FAP) and the moiety capable of specific binding to FAP comprises a VH domain comprising (i) CDR-H1 comprising the amino acid sequence of SEQ ID NO:7 or SEQ ID NO:100, (ii) CDR-H2 comprising the amino acid sequence of SEQ ID NO:8 or SEQ ID NO:101, and (iii) CDR-H3 comprising the amino acid sequence of SEQ ID NO:9 or SEQ ID NO:102, and a VL domain comprising (iv) CDR-L1 comprising the amino acid sequence of SEQ ID NO:10 or SEQ ID NO:103, (v) CDR-L2 comprising the amino acid sequence of SEQ ID NO:11 or SEQ ID NO:104, and (vi) CDR-L3 comprising the amino acid sequence of SEQ ID NO:12 or SEQ ID NO:105.

In a particular aspect, the TNF family ligand trimer-containing antigen binding molecule of comprises
(i) a first heavy chain comprising the VH domain comprising the amino acid sequence of SEQ ID NO:16 and a first light chain comprising the VL domain comprising the amino acid sequence of SEQ ID NO:17 or a first heavy chain comprising the VH domain comprising the amino acid sequence of SEQ ID NO:106 and a first light chain comprising the VL domain comprising the amino acid sequence of SEQ ID NO:107, (ii) a second heavy chain comprising the amino acid sequence selected from the group consisting of SEQ ID NO:355, and (iii) a second light chain comprising the amino acid sequence of SEQ ID NO:356.

TNF family ligand trimer-containing antigen binding molecules, wherein the target cell antigen is CD19

In a particular aspect, provided is a TNF family ligand trimer-containing antigen binding molecule, wherein the target cell antigen is CD19.

In one aspect, the invention provides a TNF family ligand trimer-containing antigen binding molecule, wherein the moiety capable of specific binding to CD19 comprises a VH domain comprising (i) CDR-H1 comprising the amino acid sequence of SEQ ID NO:195 or SEQ ID NO:252, (ii) CDR-H2 comprising the amino acid sequence of SEQ ID NO:196 or SEQ ID NO:253, and (iii) CDR-H3 comprising the amino acid sequence of SEQ ID NO:197 or SEQ ID NO:254, and a VL domain comprising (iv) CDR-L1 comprising the amino acid sequence of SEQ ID NO:198 or SEQ ID NO:249, (v) CDR-L2 comprising the amino acid sequence of SEQ ID NO:199 or SEQ ID NO:250, and (vi) CDR-L3 comprising the amino acid sequence of SEQ ID NO:200 or SEQ ID NO:251.

In a particular aspect, provided is a TNF family ligand trimer-containing antigen binding molecule of the invention, wherein the moiety capable of specific binding to a target cell antigen is a Fab molecule capable of specific binding to CD19 and comprises a VH domain comprising (i) CDR-H1 comprising the amino acid sequence of SEQ ID NO:195, (ii) CDR-H2 comprising the amino acid sequence of SEQ ID NO:196 and (iii) CDR-H3 comprising the amino acid sequence of SEQ ID NO:197, and a VL domain comprising (iv) CDR-L1 comprising the amino acid sequence of SEQ ID NO:198, (v) CDR-L2 comprising the amino acid sequence of SEQ ID NO:199 and (vi) CDR-L3 comprising the amino acid sequence of SEQ ID NO:200.

In a further aspect, provided is a TNF family ligand trimer-containing antigen binding molecule of the invention, wherein the moiety capable of specific binding to a target cell antigen is a Fab molecule capable of specific binding to CD19 and comprises a VH domain comprising (i) CDR-H1 comprising the amino acid sequence of SEQ ID NO:252, (ii) CDR-H2 comprising the amino acid sequence of SEQ ID NO:253 and (iii) CDR-H3 comprising the amino acid sequence of SEQ ID NO:254, and a VL domain comprising (iv) CDR-L1 comprising the amino acid sequence of SEQ ID NO:249, (v) CDR-L2 comprising the amino acid sequence of SEQ ID NO:250 and (vi) CDR-L3 comprising the amino acid sequence of SEQ ID NO:251.

In another aspect, the moiety capable of specific binding to CD19 comprises a heavy chain variable region comprising an amino acid sequence that is at least about 95%, 96%, 97%, 98%, 99% or 100% identical to the amino acid sequence of SEQ ID NO:201 and a light chain variable region comprising an amino acid sequence that is at least about 95%, 96%, 97%, 98%, 99% or 100% identical to the amino acid sequence of SEQ ID NO:202.

In a further aspect, the moiety capable of specific binding to CD19 comprises a heavy chain variable region comprising an amino acid sequence that is at least about 95%, 96%, 97%, 98%, 99% or 100% identical to the amino acid sequence of SEQ ID NO:357 and a light chain variable region comprising an amino acid sequence that is at least about 95%, 96%, 97%, 98%, 99% or 100% identical to the amino acid sequence of SEQ ID NO:358.

In one aspect, the moiety capable of specific binding to CD19 comprises a variable heavy chain comprising an amino acid sequence of SEQ ID NO:201 and a variable light chain comprising an amino acid sequence of SEQ ID NO:202 or wherein the moiety capable of specific binding to CD19 comprises a variable heavy chain comprising an amino acid sequence of SEQ ID NO:357 and a variable light chain comprising an amino acid sequence of SEQ ID NO:358.

In a particular aspect, the moiety capable of specific binding to CD19 comprises a heavy chain variable region comprising the amino acid sequence of SEQ ID NO:201 and a light chain variable region comprising the amino acid sequence of SEQ ID NO:202. In another particular aspect, the moiety capable of specific binding to CD19 comprises a heavy chain variable region comprising the amino acid sequence of SEQ ID NO:357 and a light chain variable region comprising the amino acid sequence of SEQ ID NO:358.

In another aspect, the TNF family ligand trimer-containing antigen binding molecule of the invention comprises
(a) at least one moiety capable of specific binding to a target cell antigen comprising a heavy chain variable region comprising the amino acid sequence of SEQ ID NO:201 and a light chain variable region comprising the amino acid sequence of SEQ ID NO:202, and
(b) a first and a second polypeptide that are linked to each other by a disulfide bond,
wherein the antigen binding molecule is characterized in that the first polypeptide comprises the amino acid sequence selected from the group consisting of SEQ ID NO:5, SEQ ID NO:97, SEQ ID NO:98 and SEQ ID NO:99 and in that the second polypeptide comprises the amino acid sequence selected from the group consisting of SEQ ID NO:1, SEQ ID NO:96, SEQ ID NO:3 and SEQ ID NO:4.

In a particular aspect, the TNF family ligand trimer-containing antigen binding molecule of the invention comprises
(a) at least one moiety capable of specific binding to a target cell antigen comprising a heavy chain variable region comprising the amino acid sequence of SEQ ID NO:201 and a light chain variable region comprising the amino acid sequence of SEQ ID NO:202, and
(b) a first and a second polypeptide that are linked to each other by a disulfide bond,
wherein the antigen binding molecule is characterized in that the first polypeptide comprises the the amino acid sequence of SEQ ID NO:97 and the second polypeptide comprises the amino acid sequence of SEQ ID NO:96.

In another aspect, the TNF family ligand trimer-containing antigen binding molecule of the invention comprises
(a) at least one moiety capable of specific binding to a target cell antigen comprising a heavy chain variable region comprising the amino acid sequence of SEQ ID NO:357 and a light chain variable region comprising the amino acid sequence of SEQ ID NO:358, and
(b) a first and a second polypeptide that are linked to each other by a disulfide bond,
wherein the antigen binding molecule is characterized in that the first polypeptide comprises the amino acid sequence selected from the group consisting of SEQ ID NO:5, SEQ ID NO:97, SEQ ID NO:98 and SEQ ID NO:99 and in that the second polypeptide comprises the amino acid sequence selected from the group consisting of SEQ ID NO:1, SEQ ID NO:96, SEQ ID NO:3 and SEQ ID NO:4.

In a particular aspect, the TNF family ligand trimer-containing antigen binding molecule of the invention comprises
(a) at least one moiety capable of specific binding to a target cell antigen comprising a heavy chain variable region comprising the amino acid sequence of SEQ ID NO:357 and a light chain variable region comprising the amino acid sequence of SEQ ID NO:358, and
(b) a first and a second polypeptide that are linked to each other by a disulfide bond,
wherein the antigen binding molecule is characterized in that the first polypeptide comprises the the amino acid sequence of SEQ ID NO:97 and the second polypeptide comprises the amino acid sequence of SEQ ID NO:96.

In another aspect, provided is a TNF family ligand trimer-containing antigen binding molecule, wherein the antigen binding molecule comprises
a first heavy chain and a first light chain, both comprising a Fab molecule capable of specific binding to a target cell antigen,
a second heavy chain comprising two ectodomains of a TNF ligand family member or fragments thereof connected to each other by a first peptide linker that is fused at its C-terminus by a second peptide linker to a CH1 domain, and a second light chain comprising one ectodomain of said TNF ligand family member or a fragment thereof is fused at its C-terminus by a third peptide linker to a CL domain, and
wherein the antigen binding molecule comprises
(i) a first heavy chain comprising the VH domain comprising the amino acid sequence of SEQ ID NO:201 and a first light chain comprising the VL domain comprising the amino acid sequence of SEQ ID NO:202 or
a first heavy chain comprising the VH domain comprising the amino acid sequence of SEQ ID NO:357 and a first light chain comprising the VL domain comprising the amino acid sequence of SEQ ID NO:358,
(ii) a second heavy chain comprising the amino acid sequence selected from the group consisting of SEQ ID NO:14, SEQ ID NO:108, SEQ ID NO:111 and SEQ ID NO:113, and
(iii) a second light chain comprising the amino acid sequence of SEQ ID NO:15, SEQ ID NO:109, SEQ ID NO:110, SEQ ID NO:112 and SEQ ID NO:114.

In a further particular aspect, provided is a TNF family ligand trimer-containing antigen binding molecule, and wherein the antigen binding molecule comprises
a first heavy chain and a first light chain, both comprising a Fab molecule capable of specific binding to a target cell antigen,
a second heavy chain comprising two ectodomains of a TNF ligand family member or fragments thereof connected to each other by a first peptide linker is fused at its C-terminus by a second peptide linker to a CL domain, and a second light chain comprising one ectodomain of said TNF ligand family member or a fragment thereof that is fused at its C-terminus by a third peptide linker to a CH1 domain, and
wherein the molecule comprises
(i) a first heavy chain comprising the VH domain comprising the amino acid sequence of SEQ ID NO:201 and a first light chain comprising the VL domain comprising the amino acid sequence of SEQ ID NO:202 or
a first heavy chain comprising the VH domain comprising the amino acid sequence of SEQ ID NO:357 and a first light chain comprising the VL domain comprising the amino acid sequence of SEQ ID NO:358, (ii) a second heavy chain comprising the amino acid sequence selected from the group consisting of SEQ ID NO:115, SEQ ID NO:117, SEQ ID NO:119 and SEQ ID NO:173, and
(iii) a second light chain comprising the amino acid sequence selected from the group consisting of SEQ ID NO:116, SEQ ID NO:118, SEQ ID NO:120 and SEQ ID NO:174.

Furthermore, the invention provides a TNF family ligand trimer-containing antigen binding molecule, comprising
(a) at least one moiety capable of specific binding to a target cell antigen, and
(b) a first and a second polypeptide that are linked to each other by a disulfide bond,
wherein the antigen binding molecule is characterized in that the first polypeptide contains a CH3 domain and the second polypeptide contains a CH3 domain, respectively, and wherein the first polypeptide comprises two ectodomains of a TNF ligand family member or fragments thereof that are connected to each other and to the C-terminus of the CH3 domain by a peptide linker and wherein the second polypeptide comprises one ectodomain of said TNF ligand family member or a fragment thereof connected via a peptide linker to C-terminus of the CH3 domain of said polypeptide.

In a particular aspect, such a TNF family ligand trimer-containing antigen binding molecule comprises two moieties capable of specific binding to a target cell antigen.

More particular, such TNF family ligand trimer-containing antigen binding molecule comprises
(i) a first heavy chain comprising the amino acid sequence of SEQ ID NO:209, a second heavy chain comprising the amino acid sequence of SEQ ID NO:210, and two light chains comprising the amino acid sequence of SEQ ID NO:206, or
(ii) a first heavy chain comprising the amino acid sequence of SEQ ID NO:213, a second heavy chain comprising the amino acid sequence of SEQ ID NO:214, and two light chains comprising the amino acid sequence of SEQ ID NO:206, or
(iii) a first heavy chain comprising the amino acid sequence of SEQ ID NO:309, a second heavy chain comprising the amino acid sequence of SEQ ID NO:310, and two light chains comprising the amino acid sequence of SEQ ID NO:279, or
(iv) a first heavy chain comprising the amino acid sequence of SEQ ID NO:313, a second heavy chain comprising the amino acid sequence of SEQ ID NO:314, and two light chains comprising the amino acid sequence of SEQ ID NO:279.

In a further aspect, the invention relates to a TNF family ligand trimer-containing antigen binding molecule, selected from the group consisting of:
a) a molecule comprising a first heavy chain comprising the amino acid sequence of SEQ ID NO:205, a first light chain comprising the amino acid sequence of SEQ ID NO:206, a second heavy chain comprising the amino acid sequence of SEQ ID NO:115 and a second light chain comprising the amino acid sequence of SEQ ID NO:116;
b) a molecule comprising a first heavy chain comprising the amino acid sequence of SEQ ID NO:205, a first light chain comprising the amino acid sequence of SEQ ID NO:206, a second heavy chain comprising the amino acid sequence of SEQ ID NO:117 and a second light chain comprising the amino acid sequence of SEQ ID NO:118;
c) a molecule comprising two light chains comprising the amino acid sequence of SEQ ID NO:206, a first heavy chain comprising the amino acid sequence of SEQ ID NO:209 and a second heavy chain comprising the amino acid sequence of SEQ ID NO:210;
d) a molecule comprising a first heavy chain comprising the amino acid sequence of SEQ ID NO:205, a first light chain comprising the amino acid sequence of SEQ ID NO:206, a second heavy chain comprising the amino acid sequence of SEQ ID NO:119 and a second light chain comprising the amino acid sequence of SEQ ID NO:120;
e) a molecule comprising a first heavy chain comprising the amino acid sequence of SEQ ID NO:205, a first light chain comprising the amino acid sequence of SEQ ID NO:206, a second heavy chain comprising the amino acid sequence of SEQ ID NO:173 and a second light chain comprising the amino acid sequence of SEQ ID NO:174; and
f) a molecule comprising two light chains comprising the amino acid sequence of SEQ ID NO:206, a first heavy chain comprising the amino acid sequence of SEQ ID NO:213 and a second heavy chain comprising the amino acid sequence of SEQ ID NO:214.

In particular, the invention provides a TNF family ligand trimer-containing antigen binding molecule comprising a first heavy chain comprising the amino acid sequence of SEQ ID NO:205, a first light chain comprising the amino acid sequence of SEQ ID NO:206, a second heavy chain comprising the amino acid sequence of SEQ ID NO:119 and a second light chain comprising the amino acid sequence of SEQ ID NO:120.

In another aspect, the invention relates to a TNF family ligand trimer-containing antigen binding molecule, selected from the group consisting of:
a) a molecule comprising a first heavy chain comprising the amino acid sequence of SEQ ID NO:357, a first light chain comprising the amino acid sequence of SEQ ID NO:358, a second heavy chain comprising the amino acid sequence of SEQ ID NO:115 and a second light chain comprising the amino acid sequence of SEQ ID NO:116;
b) a molecule comprising a first heavy chain comprising the amino acid sequence of SEQ ID NO:357, a first light chain comprising the amino acid sequence of SEQ ID NO:358, a second heavy chain comprising the amino acid sequence of SEQ ID NO:117 and a second light chain comprising the amino acid sequence of SEQ ID NO:118;
c) a molecule comprising two light chains comprising the amino acid sequence of SEQ ID NO:358, a first heavy chain comprising the amino acid sequence of SEQ ID NO:209 and a second heavy chain comprising the amino acid sequence of SEQ ID NO:210;
d) a molecule comprising a first heavy chain comprising the amino acid sequence of SEQ ID NO:357, a first light chain comprising the amino acid sequence of SEQ ID NO:358, a second heavy chain comprising the amino acid sequence of SEQ ID NO:119 and a second light chain comprising the amino acid sequence of SEQ ID NO:120;
e) a molecule comprising a first heavy chain comprising the amino acid sequence of SEQ ID NO:357, a first light chain comprising the amino acid sequence of SEQ ID NO:358, a second heavy chain comprising the amino acid sequence of SEQ ID NO:173 and a second light chain comprising the amino acid sequence of SEQ ID NO:174; and
f) a molecule comprising two light chains comprising the amino acid sequence of SEQ ID NO:358, a first heavy chain comprising the amino acid sequence of SEQ ID NO:213 and a second heavy chain comprising the amino acid sequence of SEQ ID NO:214.

In particular, the invention provides a TNF family ligand trimer-containing antigen binding molecule comprising a first heavy chain comprising the amino acid sequence of SEQ ID NO:357, a first light chain comprising the amino acid sequence of SEQ ID NO:358, a second heavy chain comprising the amino acid sequence of SEQ ID NO:119 and a second light chain comprising the amino acid sequence of SEQ ID NO:120.

TNF family ligand trimer-containing antigen binding molecules, wherein the target cell antigen is CEA In a particular aspect, provided is a TNF family ligand trimer-containing antigen binding molecule, wherein the target cell antigen is CEA.

In one aspect, the invention provides a TNF family ligand trimer-containing antigen binding molecule, wherein the moiety capable of specific binding to CD19 comprises a VH domain comprising (i) CDR-H1 comprising the amino acid sequence of SEQ ID NO:321, (ii) CDR-H2 comprising the amino acid sequence of SEQ ID NO:322, and (iii) CDR-H3 comprising the amino acid sequence of SEQ ID NO:323, and a VL domain comprising (iv) CDR-L1 comprising the amino acid sequence of SEQ ID NO:324, (v) CDR-L2 comprising the amino acid sequence of SEQ ID NO:325, and (vi) CDR-L3 comprising the amino acid sequence of SEQ ID NO:326.

In a particular aspect, provided is a TNF family ligand trimer-containing antigen binding molecule of the invention, wherein the moiety capable of specific binding to a target cell antigen is a Fab molecule capable of specific binding to CEA and comprises a VH domain comprising (i) CDR-H1 comprising the amino acid sequence of SEQ ID NO:321, (ii) CDR-H2 comprising the amino acid sequence of SEQ ID NO:322 and (iii) CDR-H3 comprising the amino acid sequence of SEQ ID NO:323, and a VL domain comprising (iv) CDR-L1 comprising the amino acid sequence of SEQ ID NO:324, (v) CDR-L2 comprising the amino acid sequence of SEQ ID NO:325 and (vi) CDR-L3 comprising the amino acid sequence of SEQ ID NO:326.

In a further aspect, the moiety capable of specific binding to CEA comprises a heavy chain variable region comprising an amino acid sequence that is at least about 95%, 96%, 97%, 98%, 99% or 100% identical to the amino acid sequence of SEQ ID NO:327 and a light chain variable region comprising an amino acid sequence that is at least about 95%, 96%, 97%, 98%, 99% or 100% identical to the amino acid sequence of SEQ ID NO:328.

In one aspect, the moiety capable of specific binding to CEA comprises a variable heavy chain comprising an amino acid sequence of SEQ ID NO:327 and a variable light chain comprising an amino acid sequence of SEQ ID NO:328.

In a further aspect, the moiety capable of specific binding to CEA comprises a heavy chain variable region comprising an amino acid sequence that is at least about 95%, 96%, 97%, 98%, 99% or 100% identical to the amino acid sequence of SEQ ID NO:329 and a light chain variable region comprising an amino acid sequence that is at least about 95%, 96%, 97%, 98%, 99% or 100% identical to the amino acid sequence of SEQ ID NO:330.

In one aspect, the moiety capable of specific binding to CEA comprises a variable heavy chain comprising an amino acid sequence of SEQ ID NO:329 and a variable light chain comprising an amino acid sequence of SEQ ID NO:330.

In another aspect, the TNF family ligand trimer-containing antigen binding molecule of the invention comprises
(a) at least one moiety capable of specific binding to a target cell antigen comprising a heavy chain variable region comprising the amino acid sequence of SEQ ID NO:329 and a light chain variable region comprising the amino acid sequence of SEQ ID NO:330, and
(b) a first and a second polypeptide that are linked to each other by a disulfide bond,
wherein the antigen binding molecule is characterized in that the first polypeptide comprises the amino acid sequence selected from the group consisting of SEQ ID NO:5, SEQ ID NO:97, SEQ ID NO:98 and SEQ ID NO:99 and in that the second polypeptide comprises the amino acid sequence selected from the group consisting of SEQ ID NO:1, SEQ ID NO:96, SEQ ID NO:3 and SEQ ID NO:4.

In a particular aspect, the TNF family ligand trimer-containing antigen binding molecule of the invention comprises
(a) at least one moiety capable of specific binding to a target cell antigen comprising a heavy chain variable region comprising the amino acid sequence of SEQ ID NO:329 and a light chain variable region comprising the amino acid sequence of SEQ ID NO:330, and
(b) a first and a second polypeptide that are linked to each other by a disulfide bond,
wherein the antigen binding molecule is characterized in that the first polypeptide comprises the the amino acid sequence of SEQ ID NO:97 and the second polypeptide comprises the amino acid sequence of SEQ ID NO:96.

In another aspect, provided is a TNF family ligand trimer-containing antigen binding molecule, wherein the antigen binding molecule comprises
a first heavy chain and a first light chain, both comprising a Fab molecule capable of specific binding to a target cell antigen,
a second heavy chain comprising two ectodomains of a TNF ligand family member or fragments thereof connected to each other by a first peptide linker that is fused at its C-terminus by a second peptide linker to a CH1 domain, and a second light chain comprising one ectodomain of said TNF ligand family member or a fragment thereof is fused at its C-terminus by a third peptide linker to a CL domain, and wherein the antigen binding molecule comprises
(i) a first heavy chain comprising the VH domain comprising the amino acid sequence of SEQ ID NO:329 and a first light chain comprising the VL domain comprising the amino acid sequence of SEQ ID NO:330,
(ii) a second heavy chain comprising the amino acid sequence selected from the group consisting of SEQ ID NO:14, SEQ ID NO:108, SEQ ID NO:111 and SEQ ID NO:113, and
(iii) a second light chain comprising the amino acid sequence of SEQ ID NO:15, SEQ ID NO:109, SEQ ID NO:110, SEQ ID NO:112 and SEQ ID NO:114.

In a further particular aspect, provided is a TNF family ligand trimer-containing antigen binding molecule, and wherein the antigen binding molecule comprises
a first heavy chain and a first light chain, both comprising a Fab molecule capable of specific binding to a target cell antigen,
a second heavy chain comprising two ectodomains of a TNF ligand family member or fragments thereof connected to each other by a first peptide linker is fused at its C-terminus by a second peptide linker to a CL domain, and a second light chain comprising one ectodomain of said TNF ligand family member or a fragment thereof that is fused at its C-terminus by a third peptide linker to a CH1 domain, and wherein the molecule comprises
i) a first heavy chain comprising the VH domain comprising the amino acid sequence of SEQ ID NO:329 and a first light chain comprising the VL domain comprising the amino acid sequence of SEQ ID NO:330, (ii) a second heavy chain comprising the amino acid sequence selected from the group consisting of SEQ ID NO:115, SEQ ID NO:117, SEQ ID NO:119 and SEQ ID NO:173, and (iii) a second light chain comprising the amino acid sequence selected from the group consisting of SEQ ID NO:116, SEQ ID NO:118, SEQ ID NO:120 and SEQ ID NO:174.

Furthermore, the invention provides a TNF family ligand trimer-containing antigen binding molecule, comprising (a) at least one moiety capable of specific binding to a target cell antigen, and (b) a first and a second polypeptide that are linked to each other by a disulfide bond, wherein the antigen binding molecule is characterized in that the first polypeptide contains a CH3 domain and the second polypeptide contains a CH3 domain, respectively, and wherein the first polypeptide comprises two ectodomains of a TNF ligand family member or fragments thereof that are connected to each other and to the C-terminus of the CH3 domain by a peptide linker and wherein the second polypeptide comprises one ectodomain of said TNF ligand family member or a fragment thereof connected via a peptide linker to C-terminus of the CH3 domain of said polypeptide.

In a particular aspect, such a TNF family ligand trimer-containing antigen binding molecule comprises two moieties capable of specific binding to a target cell antigen.

More particular, such TNF family ligand trimer-containing antigen binding molecule comprises (i) a first heavy chain comprising the amino acid sequence of SEQ ID NO:337, a second heavy chain comprising the amino acid sequence of SEQ ID NO:338, and two light chains comprising the amino acid sequence of SEQ ID NO:334, or (ii) a first heavy chain comprising the amino acid sequence of SEQ ID NO:341, a second heavy chain comprising the amino acid sequence of SEQ ID NO:342, and two light chains comprising the amino acid sequence of SEQ ID NO:334.

In a further aspect, the invention relates to a TNF family ligand trimer-containing antigen binding molecule, selected from the group consisting of:

a) a molecule comprising a first heavy chain comprising the amino acid sequence of SEQ ID NO:333, a first light chain comprising the amino acid sequence of SEQ ID NO:334, a second heavy chain comprising the amino acid sequence of SEQ ID NO:115 and a second light chain comprising the amino acid sequence of SEQ ID NO:116;

b) a molecule comprising a first heavy chain comprising the amino acid sequence of SEQ ID NO:333, a first light chain comprising the amino acid sequence of SEQ ID NO:334, a second heavy chain comprising the amino acid sequence of SEQ ID NO:117 and a second light chain comprising the amino acid sequence of SEQ ID NO:118;

c) a molecule comprising two light chains comprising the amino acid sequence of SEQ ID NO:334, a first heavy chain comprising the amino acid sequence of SEQ ID NO:337 and a second heavy chain comprising the amino acid sequence of SEQ ID NO:338;

d) a molecule comprising a first heavy chain comprising the amino acid sequence of SEQ ID NO:333, a first light chain comprising the amino acid sequence of SEQ ID NO:334, a second heavy chain comprising the amino acid sequence of SEQ ID NO:119 and a second light chain comprising the amino acid sequence of SEQ ID NO:120;

e) a molecule comprising a first heavy chain comprising the amino acid sequence of SEQ ID NO:333, a first light chain comprising the amino acid sequence of SEQ ID NO:334, a second heavy chain comprising the amino acid sequence of SEQ ID NO:173 and a second light chain comprising the amino acid sequence of SEQ ID NO:174; and f) a molecule comprising two light chains comprising the amino acid sequence of SEQ ID NO:334, a first heavy chain comprising the amino acid sequence of SEQ ID NO:341 and a second heavy chain comprising the amino acid sequence of SEQ ID NO:342.

In particular, the invention provides a TNF family ligand trimer-containing antigen binding molecule comprising a first heavy chain comprising the amino acid sequence of SEQ ID NO:333, a first light chain comprising the amino acid sequence of SEQ ID NO:334, a second heavy chain comprising the amino acid sequence of SEQ ID NO:119 and a second light chain comprising the amino acid sequence of SEQ ID NO:120.

Polynucleotides

The invention further provides isolated polynucleotides encoding a TNF family ligand trimer-containing antigen binding molecule as described herein or a fragment thereof.

The isolated polynucleotides encoding TNF ligand trimer-containing antigen binding molecules of the invention may be expressed as a single polynucleotide that encodes the entire antigen binding molecule or as multiple (e.g., two or more) polynucleotides that are co-expressed. Polypeptides encoded by polynucleotides that are co-expressed may associate through, e.g., disulfide bonds or other means to form a functional antigen binding molecule. For example, the light chain portion of an immunoglobulin may be encoded by a separate polynucleotide from the heavy chain portion of the immunoglobulin. When co-expressed, the heavy chain polypeptides will associate with the light chain polypeptides to form the immunoglobulin.

In some aspects, the isolated polynucleotide encodes the entire TNF family ligand trimer-containing antigen binding molecule according to the invention as described herein. In particular, the isolated polynucleotide encodes a polypeptide comprised in the TNF family ligand trimer-containing antigen binding molecule according to the invention as described herein.

In one aspect, the present invention is directed to an isolated polynucleotide encoding a TNF family ligand trimer-containing antigen binding molecule, wherein the polynucleotide comprises (a) a sequence that encodes a moiety capable of specific binding to a target cell antigen, (b) a sequence that encodes a polypeptide comprising two ectodomains of a TNF ligand family member or two fragments thereof that are connected to each other by a peptide linker and (c) a sequence that encodes a polypeptide comprising one ectodomain of said TNF ligand family member or a fragment thereof.

In another aspect, provided is an isolated polynucleotide encoding a 4-1BB ligand trimer-containing antigen binding molecule, wherein the polynucleotide comprises (a) a sequence that encodes a moiety capable of specific binding to a target cell antigen, (b) a sequence that encodes a polypeptide comprising two ectodomains of 4-1BBL or two fragments thereof that are connected to each other by a peptide linker and (c) a sequence that encodes a polypeptide comprising one ectodomain of 4-1BBL or a fragment thereof.

In a further aspect, the invention is directed to an isolated polynucleotide comprising a sequence that encodes a polypeptide comprising two 4-1BBL fragments comprising an amino acid sequence that is at least about 90%, 95%, 98% or 100% identical to an amino acid sequence shown in SEQ ID NO:1, SEQ ID NO:2, SEQ ID NO:3, SEQ ID NO:4 or SEQ ID NO:96, and to a polynucleotide comprising a sequence that encodes a polypeptide comprising one 4-1BBL fragment comprising an amino acid sequence that is is at least about 90%, 95%, 98% or 100% identical to an amino acid sequence shown in SEQ ID NO:1, SEQ ID NO:2, SEQ ID NO:3, SEQ ID NO:4 or SEQ ID NO:96.

Furthermore, provided is an isolated polynucleotide encoding a OX40 ligand trimer-containing antigen binding molecule, wherein the polynucleotide comprises (a) a sequence that encodes a moiety capable of specific binding to a target cell antigen, (b) a sequence that encodes a polypeptide comprising two ectodomains of OX40L or two fragments thereof that are connected to each other by a peptide linker and (c) a sequence that encodes a polypeptide comprising one ectodomain of OX40L or a fragment thereof.

In another aspect, the invention is directed to an isolated polynucleotide comprising a sequence that encodes a polypeptide comprising two 4-1BBL fragments comprising an amino acid sequence that is at least about 90%, 95%, 98% or 100% identical to an amino acid sequence shown in SEQ ID NO:53 or SEQ ID NO:54, and to a polynucleotide comprising a sequence that encodes a polypeptide comprising one 4-1BBL fragment comprising an amino acid sequence that is is at least about 90%, 95%, 98% or 100% identical to an amino acid sequence shown in SEQ ID NO:53 or SEQ ID NO:54.

In further aspects, the invention relates to the polynucleotides comprising a sequence that is at least about 90%, 95%, 98% or 100% identical to the specific cDNA sequences disclosed herein. In a particular aspect, the invention relates to a polynucleotide comprising a sequence that is identical to one of the specific cDNA sequences disclosed herein.

In other aspects, the nucleic acid molecule comprises or consists of a nucleotide sequence that encodes an amino acid sequence as set forth in any one of SEQ ID NOs: 5, 6, 97, 98, 99, 183, 184 or 185. In a further aspect, the nucleic acid molecule comprises or consists of a nucleotide sequence that encodes an amino acid sequence as set forth in any one of SEQ ID NOs:14, 15, 108, 109, 110, 111, 112, 113, 114, 115, 116, 117, 118, 119, 120, 173 or 174.

In still other aspects, the nucleic acid molecule comprises or consists of a nucleotide sequence selected from the group consisting of SEQ ID NOs: 66, 67, 68, 69, 129, 130, 131, 132, 133, 134, 137, 138, 141, 142, 143, 144, 146, 147, 150, 151, 152, 153, 162, 163, 165, 166, 167, 168, 169, 170, 171, 172, 175, 176, 177, 178, 203, 204, 207, 208, 211, 212, 215, 216, 273, 274, 277, 278, 281, 282, 285, 286, 289, 290, 293, 294, 297, 298, 301, 302, 305, 307, 308, 311, 312, 315, 316, 331, 332, 335, 336, 339, 340, 343, 344, 347, 348, 353 or 354.

In certain aspects, the polynucleotide or nucleic acid is DNA. In other embodiments, a polynucleotide of the present invention is RNA, for example, in the form of messenger RNA (mRNA). RNA of the present invention may be single stranded or double stranded.

Recombinant Methods

TNF family ligand trimer-containing antigen binding molecules of the invention may be obtained, for example, by solid-state peptide synthesis (e.g. Merrifield solid phase synthesis) or recombinant production. For recombinant production one or more polynucleotide encoding the TNF family ligand trimer-containing antigen binding molecule or polypeptide fragments thereof, e.g., as described above, is isolated and inserted into one or more vectors for further cloning and/or expression in a host cell. Such polynucleotide may be readily isolated and sequenced using conventional procedures. In one aspect of the invention, a vector, preferably an expression vector, comprising one or more of the polynucleotides of the invention is provided. Methods which are well known to those skilled in the art can be used to construct expression vectors containing the coding sequence of the TNF family ligand trimer-containing antigen binding molecule (fragment) along with appropriate transcriptional/translational control signals. These methods include in vitro recombinant DNA techniques, synthetic techniques and in vivo recombination/genetic recombination. See, for example, the techniques described in Maniatis et al., MOLECULAR CLONING: A LABORATORY MANUAL, Cold Spring Harbor Laboratory, N.Y. (1989); and Ausubel et al., CURRENT PROTOCOLS IN MOLECULAR BIOLOGY, Greene Publishing Associates and Wiley Interscience, N.Y. (1989). The expression vector can be part of a plasmid, virus, or may be a nucleic acid fragment. The expression vector includes an expression cassette into which the polynucleotide encoding the TNF family ligand trimer-containing antigen binding molecule or polypeptide fragments thereof (i.e. the coding region) is cloned in operable association with a promoter and/or other transcription or translation control elements. As used herein, a "coding region" is a portion of nucleic acid which consists of codons translated into amino acids. Although a "stop codon" (TAG, TGA, or TAA) is not translated into an amino acid, it may be considered to be part of a coding region, if present, but any flanking sequences, for example promoters, ribosome binding sites, transcriptional terminators, introns, 5' and 3' untranslated regions, and the like, are not part of a coding region. Two or more coding regions can be present in a single polynucleotide construct, e.g. on a single vector, or in separate polynucleotide constructs, e.g. on separate (different) vectors. Furthermore, any vector may contain a single coding region, or may comprise two or more coding regions, e.g. a vector of the present invention may encode one or more polypeptides, which are post- or co-translationally separated into the final proteins via proteolytic cleavage. In addition, a vector, polynucleotide, or nucleic acid of the invention may encode heterologous coding regions, either fused or unfused to a polynucleotide encoding the TNF family ligand trimer-containing antigen binding molecule of the invention or polypeptide fragments thereof, or variants or derivatives thereof. Heterologous coding regions include without limitation specialized elements or motifs, such as a secretory signal peptide or a heterologous functional domain. An operable association is when a coding region for a gene product, e.g. a polypeptide, is associated with one or more regulatory sequences in such a way as to place expression of the gene product under the influence or control of the regulatory sequence(s). Two DNA fragments (such as a polypeptide coding region and a promoter associated therewith) are "operably associated" if induction of promoter function results in the transcription of mRNA encoding the desired gene product and if the nature of the linkage between the two DNA fragments does not interfere with the ability of the expression regulatory sequences to direct the expression of the gene product or interfere with the ability of the DNA template to be transcribed. Thus, a promoter region would be operably associated with a nucleic acid encoding a polypeptide if the promoter was capable of effecting transcription of that nucleic acid. The promoter may be a cell-specific promoter that directs substantial transcription of the DNA only in predetermined cells. Other transcription control elements, besides a promoter, for example enhancers, operators, repressors, and transcription termination signals, can be operably associated with the polynucleotide to direct cell-specific transcription.

Suitable promoters and other transcription control regions are disclosed herein. A variety of transcription control regions are known to those skilled in the art. These include, without limitation, transcription control regions, which function in vertebrate cells, such as, but not limited to, promoter and enhancer segments from cytomegaloviruses (e.g. the immediate early promoter, in conjunction with intron-A), simian virus 40 (e.g. the early promoter), and retroviruses (such as, e.g. Rous sarcoma virus). Other transcription control regions include those derived from vertebrate genes such as actin, heat shock protein, bovine growth hormone and rabbit ā-globin, as well as other sequences capable of controlling gene expression in eukaryotic cells. Additional suitable transcription control regions include tissue-specific promoters and enhancers as well as inducible promoters (e.g. promoters inducible tetracyclins). Similarly, a variety of translation control elements are known to those of ordinary skill in the art. These include, but are not limited to ribosome binding sites, translation initiation and termination codons, and elements derived from viral systems (particularly an internal ribosome entry site, or IRES, also referred to as a CITE sequence). The expression cassette may also include other features such as an origin of replication, and/or chromosome integration elements such as retroviral long terminal repeats (LTRs), or adeno-associated viral (AAV) inverted terminal repeats (ITRs).

Polynucleotide and nucleic acid coding regions of the present invention may be associated with additional coding regions which encode secretory or signal peptides, which direct the secretion of a polypeptide encoded by a polynucleotide of the present invention. For example, if secretion of the TNF family ligand trimer-containing antigen binding molecule or polypeptide fragments thereof is desired, DNA encoding a signal sequence may be placed upstream of the nucleic acid encoding a TNF family ligand trimer-containing antigen binding molecule of the invention or polypeptide fragments thereof. According to the signal hypothesis, proteins secreted by mammalian cells have a signal peptide or secretory leader sequence which is cleaved from the mature protein once export of the growing protein chain across the rough endoplasmic reticulum has been initiated. Those of ordinary skill in the art are aware that polypeptides secreted by vertebrate cells generally have a signal peptide fused to the N-terminus of the polypeptide, which is cleaved from the translated polypeptide to produce a secreted or "mature" form of the polypeptide. In certain embodiments, the native signal peptide, e.g. an immunoglobulin heavy chain or light chain signal peptide is used, or a functional derivative of that sequence that retains the ability to direct the secretion of the polypeptide that is operably associated with it. Alternatively, a heterologous mammalian signal peptide, or a functional derivative thereof, may be used. For example, the wild-type leader sequence may be substituted with the leader sequence of human tissue plasminogen activator (TPA) or mouse β-glucuronidase.

DNA encoding a short protein sequence that could be used to facilitate later purification (e.g. a histidine tag) or assist in labeling the fusion protein may be included within or at the ends of the polynucleotide encoding a TNF family ligand trimer-containing antigen binding molecule of the invention or polypeptide fragments thereof.

In a further aspect of the invention, a host cell comprising one or more polynucleotides of the invention is provided. In certain embodiments a host cell comprising one or more vectors of the invention is provided. The polynucleotides and vectors may incorporate any of the features, singly or in combination, described herein in relation to polynucleotides and vectors, respectively. In one aspect, a host cell comprises (e.g. has been transformed or transfected with) a vector comprising a polynucleotide that encodes (part of) a TNF family ligand trimer-containing antigen binding molecule of the invention of the invention. As used herein, the term "host cell" refers to any kind of cellular system which can be engineered to generate the fusion proteins of the invention or fragments thereof. Host cells suitable for replicating and for supporting expression of antigen binding molecules are well known in the art. Such cells may be transfected or transduced as appropriate with the particular expression vector and large quantities of vector containing cells can be grown for seeding large scale fermenters to obtain sufficient quantities of the antigen binding molecule for clinical applications. Suitable host cells include prokaryotic microorganisms, such as E. coli, or various eukaryotic cells, such as Chinese hamster ovary cells (CHO), insect cells, or the like. For example, polypeptides may be produced in bacteria in particular when glycosylation is not needed. After expression, the polypeptide may be isolated from the bacterial cell paste in a soluble fraction and can be further purified. In addition to prokaryotes, eukaryotic microbes such as filamentous fungi or yeast are suitable cloning or expression hosts for polypeptide-encoding vectors, including fungi and yeast strains whose glycosylation pathways have been "humanized", resulting in the production of a polypeptide with a partially or fully human glycosylation pattern. See Gerngross, Nat Biotech 22, 1409-1414 (2004), and Li et al., Nat Biotech 24, 210-215 (2006).

Suitable host cells for the expression of (glycosylated) polypeptides are also derived from multicellular organisms (invertebrates and vertebrates). Examples of invertebrate cells include plant and insect cells. Numerous baculoviral strains have been identified which may be used in conjunction with insect cells, particularly for transfection of Spodoptera frugiperda cells. Plant cell cultures can also be utilized as hosts. See e.g. U.S. Pat. Nos. 5,959,177, 6,040, 498, 6,420,548, 7,125,978, and 6,417,429 (describing PLANTIBODIES™ technology for producing antibodies in transgenic plants). Vertebrate cells may also be used as hosts. For example, mammalian cell lines that are adapted to grow in suspension may be useful. Other examples of useful mammalian host cell lines are monkey kidney CV1 line transformed by SV40 (COS-7); human embryonic kidney line (293 or 293T cells as described, e.g., in Graham et al., J Gen Virol 36, 59 (1977)), baby hamster kidney cells (BHK), mouse sertoli cells (TM4 cells as described, e.g., in Mather, Biol Reprod 23, 243-251 (1980)), monkey kidney cells (CV1), African green monkey kidney cells (VERO-76), human cervical carcinoma cells (HELA), canine kidney cells (MDCK), buffalo rat liver cells (BRL 3A), human lung cells (W138), human liver cells (Hep G2), mouse mammary tumor cells (MMT 060562), TRI cells (as described, e.g., in Mather et al., Annals N.Y. Acad Sci 383, 44-68 (1982)), MRC 5 cells, and FS4 cells. Other useful mammalian host cell lines include Chinese hamster ovary (CHO) cells, including dhfr-CHO cells (Urlaub et al., Proc Natl Acad Sci USA 77, 4216 (1980)); and myeloma cell lines such as YO, NS0, P3X63 and Sp2/0. For a review of certain mammalian host cell lines suitable for protein production, see, e.g., Yazaki and Wu, Methods in Molecular Biology, Vol. 248 (B.

K. C. Lo, ed., Humana Press, Totowa, N.J.), pp. 255-268 (2003). Host cells include cultured cells, e.g., mammalian cultured cells, yeast cells, insect cells, bacterial cells and plant cells, to name only a few, but also cells comprised within a transgenic animal, transgenic plant or cultured plant or animal tissue. In one embodiment, the host cell is a eukaryotic cell, preferably a mammalian cell, such as a Chinese Hamster Ovary (CHO) cell, a human embryonic kidney (HEK) cell or a lymphoid cell (e.g., YO, NS0, Sp20 cell). Standard technologies are known in the art to express foreign genes in these systems. Cells expressing a polypeptide comprising either the heavy or the light chain of an immunoglobulin, may be engineered so as to also express the other of the immunoglobulin chains such that the expressed product is an immunoglobulin that has both a heavy and a light chain.

In one aspect, a method of producing a TNF family ligand trimer-containing antigen binding molecule of the invention or polypeptide fragments thereof is provided, wherein the method comprises culturing a host cell comprising polynucleotides encoding the TNF family ligand trimer-containing antigen binding molecule of the invention or polypeptide fragments thereof, as provided herein, under conditions suitable for expression of the TNF family ligand trimer-containing antigen binding molecule of the invention or polypeptide fragments thereof, and recovering the TNF family ligand trimer-containing antigen binding molecule of the invention or polypeptide fragments thereof from the host cell (or host cell culture medium).

In the TNF family ligand trimer-containing antigen binding molecule of the invention, the components (at least one moiety capable of specific binding to a target cell antigen, one polypeptide comprising two ectodomains of a TNF ligand family member or fragments thereof and a polypeptide comprising one ectodomain of said TNF family ligand family member or a fragment thereof) are not genetically fused to each other. The polypeptides are designed such that its components (two ectodomains of a TNF ligand family member or fragments thereof and other components such as CH or CL) are fused to each other directly or through a linker sequence. The composition and length of the linker may be determined in accordance with methods well known in the art and may be tested for efficacy. Examples of linker sequences between different components of the antigen binding molecules of the invention are found in the sequences provided herein. Additional sequences may also be included to incorporate a cleavage site to separate the individual components of the fusion protein if desired, for example an endopeptidase recognition sequence.

In certain embodiments the moieties capable of specific binding to a target cell antigen (e.g. Fab fragments) forming part of the antigen binding molecule comprise at least an immunoglobulin variable region capable of binding to an antigen. Variable regions can form part of and be derived from naturally or non-naturally occurring antibodies and fragments thereof. Methods to produce polyclonal antibodies and monoclonal antibodies are well known in the art (see e.g. Harlow and Lane, "Antibodies, a laboratory manual", Cold Spring Harbor Laboratory, 1988). Non-naturally occurring antibodies can be constructed using solid phase-peptide synthesis, can be produced recombinantly (e.g. as described in U.S. Pat. No. 4,186,567) or can be obtained, for example, by screening combinatorial libraries comprising variable heavy chains and variable light chains (see e.g. U.S. Pat. No. 5,969,108 to McCafferty).

Any animal species of immunoglobulin can be used in the invention. Non-limiting immunoglobulins useful in the present invention can be of murine, primate, or human origin. If the fusion protein is intended for human use, a chimeric form of immunoglobulin may be used wherein the constant regions of the immunoglobulin are from a human. A humanized or fully human form of the immunoglobulin can also be prepared in accordance with methods well known in the art (see e. g. U.S. Pat. No. 5,565,332 to Winter). Humanization may be achieved by various methods including, but not limited to (a) grafting the non-human (e.g., donor antibody) CDRs onto human (e.g. recipient antibody) framework and constant regions with or without retention of critical framework residues (e.g. those that are important for retaining good antigen binding affinity or antibody functions), (b) grafting only the non-human specificity-determining regions (SDRs or a-CDRs; the residues critical for the antibody-antigen interaction) onto human framework and constant regions, or (c) transplanting the entire non-human variable domains, but "cloaking" them with a human-like section by replacement of surface residues. Humanized antibodies and methods of making them are reviewed, e.g., in Almagro and Fransson, Front Biosci 13, 1619-1633 (2008), and are further described, e.g., in Riechmann et al., Nature 332, 323-329 (1988); Queen et al., Proc Natl Acad Sci USA 86, 10029-10033 (1989); U.S. Pat. Nos. 5,821,337, 7,527,791, 6,982,321, and 7,087,409; Jones et al., Nature 321, 522-525 (1986); Morrison et al., Proc Natl Acad Sci 81, 6851-6855 (1984); Morrison and Oi, Adv Immunol 44, 65-92 (1988); Verhoeyen et al., Science 239, 1534-1536 (1988); Padlan, Molec Immun 31(3), 169-217 (1994); Kashmiri et al., Methods 36, 25-34 (2005) (describing SDR (a-CDR) grafting); Padlan, Mol Immunol 28, 489-498 (1991) (describing "resurfacing"); Dall'Acqua et al., Methods 36, 43-60 (2005) (describing "FR shuffling"); and Osbourn et al., Methods 36, 61-68 (2005) and Klimka et al., Br J Cancer 83, 252-260 (2000) (describing the "guided selection" approach to FR shuffling). Particular immunoglobulins according to the invention are human immunoglobulins. Human antibodies and human variable regions can be produced using various techniques known in the art. Human antibodies are described generally in van Dijk and van de Winkel, Curr Opin Pharmacol 5, 368-74 (2001) and Lonberg, Curr Opin Immunol 20, 450-459 (2008). Human variable regions can form part of and be derived from human monoclonal antibodies made by the hybridoma method (see e.g. Monoclonal Antibody Production Techniques and Applications, pp. 51-63 (Marcel Dekker, Inc., New York, 1987)). Human antibodies and human variable regions may also be prepared by administering an immunogen to a transgenic animal that has been modified to produce intact human antibodies or intact antibodies with human variable regions in response to antigenic challenge (see e.g. Lonberg, Nat Biotech 23, 1117-1125 (2005). Human antibodies and human variable regions may also be generated by isolating Fv clone variable region sequences selected from human-derived phage display libraries (see e.g., Hoogenboom et al. in Methods in Molecular Biology 178, 1-37 (O'Brien et al., ed., Human Press, Totowa, N.J., 2001); and McCafferty et al., Nature 348, 552-554; Clackson et al., Nature 352, 624-628 (1991)). Phage typically display antibody fragments, either as single-chain Fv (scFv) fragments or as Fab fragments.

In certain aspects, the moieties capable of specific binding to a target cell antigen (e.g. Fab fragments) comprised in the antigen binding molecules of the present invention are engineered to have enhanced binding affinity according to, for example, the methods disclosed in PCT publication WO 2012/020006 (see Examples relating to affinity maturation) or U.S. Pat. Appl. Publ. No. 2004/0132066. The ability of the antigen binding molecules of the invention to bind to a specific antigenic determinant can be measured either through an enzyme-linked immunosorbent assay (ELISA) or other techniques familiar to one of skill in the art, e.g. surface plasmon resonance technique (Liljeblad, et al., Glyco J 17, 323-329 (2000)), and traditional binding assays (Heeley, Endocr Res 28, 217-229 (2002)). Competition assays may be used to identify an antigen binding molecule that competes with a reference antibody for binding to a particular antigen. In certain embodiments, such a competing antigen binding molecule binds to the same epitope (e.g. a linear or a conformational epitope) that is bound by the reference antigen binding molecule. Detailed exemplary methods for mapping an epitope to which an antigen binding molecule binds are provided in Morris (1996) "Epitope Mapping Protocols", in Methods in Molecular Biology vol. 66 (Humana Press, Totowa, N.J.). In an exemplary competition assay, immobilized antigen is incubated in a solution comprising a first labeled antigen binding molecule that binds to the antigen and a second unlabeled antigen binding molecule that is being tested for its ability to compete with the first antigen binding molecule for binding to the antigen. The second antigen binding molecule may be present in a hybridoma supernatant. As a control, immobilized antigen is incubated in a solution comprising the first labeled antigen binding molecule but not the second unlabeled antigen binding molecule. After incubation under conditions permissive for binding of the first antibody to the antigen, excess unbound antibody is removed, and the amount of label associated with immobilized antigen is measured. If the amount of label associated with immobilized antigen is substantially reduced in the test sample relative to the control sample, then that indicates that the second antigen binding molecule is competing with the first antigen binding molecule for binding to the antigen. See Harlow and Lane (1988) Antibodies: A Laboratory Manual ch. 14 (Cold Spring Harbor Laboratory, Cold Spring Harbor, N.Y.).

TNF ligand trimer-containing antigen binding molecules of the invention prepared as described herein may be purified by art-known techniques such as high performance liquid chromatography, ion exchange chromatography, gel electrophoresis, affinity chromatography, size exclusion chromatography, and the like. The actual conditions used to purify a particular protein will depend, in part, on factors such as net charge, hydrophobicity, hydrophilicity etc., and will be apparent to those having skill in the art. For affinity chromatography purification an antibody, ligand, receptor or antigen can be used to which the TNF ligand trimer-containing antigen binding molecule binds. For example, for affinity chromatography purification of fusion proteins of the invention, a matrix with protein A or protein G may be used. Sequential Protein A or G affinity chromatography and size exclusion chromatography can be used to isolate an antigen binding molecule essentially as described in the Examples. The purity of the TNF ligand trimer-containing antigen binding molecule or fragments thereof can be determined by any of a variety of well-known analytical methods including gel electrophoresis, high pressure liquid chromatography, and the like. For example, the TNF ligand trimer-containing antigen binding molecules expressed as described in the Examples were shown to be intact and properly assembled as demonstrated by reducing and non-reducing SDS-PAGE.

Assays

The antigen binding molecules provided herein may be identified, screened for, or characterized for their physical/chemical properties and/or biological activities by various assays known in the art.

1. Affinity Assays

The affinity of the TNF family ligand trimer-containing antigen binding molecule provided herein for the corresponding TNF receptor can be determined in accordance with the methods set forth in the Examples by surface plasmon resonance (SPR), using standard instrumentation such as a BIACORE® instrument (GE Healthcare), and receptors or target proteins such as may be obtained by recombinant expression. The affinity of the TNF family ligand trimer-containing antigen binding molecule for the target cell antigen can also be determined by surface plasmon resonance (SPR), using standard instrumentation such as a BIACORE® instrument (GE Healthcare), and receptors or target proteins such as may be obtained by recombinant expression. A specific illustrative and exemplary embodiment for measuring binding affinity is described in Example 4. According to one aspect, $K_D$ is measured by surface plasmon resonance using a BIACORE® T100 machine (GE Healthcare) at 25° C.

2. Binding Assays and Other Assays

Binding of the TNF family ligand trimer-containing antigen binding molecule provided herein to the corresponding receptor expressing cells may be evaluated using cell lines expressing the particular receptor or target antigen, for example by flow cytometry (FACS). In one aspect, fresh peripheral blood mononuclear cells (PBMCs) expressing the TNF receptor are used in the binding assay. These cells are used directly after isolation (naïve PMBCs) or after stimulation (activated PMBCs). In another aspect, activated mouse splenocytes (expressing the TNF receptor molecule) were used to demonstrate the binding of the TNF family ligand trimer-containing antigen binding molecule of the invention to the corresponding TNF receptor expressing cells.

In a further aspect, cancer cell lines expressing the target cell antigen, for example FAP, were used to demonstrate the binding of the antigen binding molecules to the target cell antigen.

In another aspect, competition assays may be used to identify an antigen binding molecule that competes with a specific antibody or antigen binding molecule for binding to the target or TNF receptor, respectively. In certain embodiments, such a competing antigen binding molecule binds to the same epitope (e.g., a linear or a conformational epitope) that is bound by a specific anti-target antibody or a specific anti-TNF receptor antibody. Detailed exemplary methods for mapping an epitope to which an antibody binds are provided in Morris (1996) "Epitope Mapping Protocols," in *Methods in Molecular Biology* vol. 66 (Humana Press, Totowa, N.J.).

3. Activity Assays

In one aspect, assays are provided for identifying TNF family ligand trimer-containing antigen binding molecules that bind to a specific target cell antigen and to a specific TNF receptor having biological activity. Biological activity may include, e.g., agonistic signalling through the TNF receptor on cells expressing the target cell antigen. TNF family ligand trimer-containing antigen binding molecules identified by the assays as having such biological activity in vitro are also provided.

In certain aspects, a TNF family ligand trimer-containing antigen binding molecule of the invention is tested for such biological activity. Assays for detecting the biological activity of the molecules of the invention are those described in Example 6. Furthermore, assays for detecting cell lysis (e.g. by measurement of LDH release), induced apoptosis kinetics (e.g. by measurement of Caspase 3/7 activity) or apoptosis (e.g. using the TUNEL assay) are well known in the art. In addition the biological activity of such complexes can be assessed by evaluating their effects on survival, proliferation and lymphokine secretion of various lymphocyte subsets such as NK cells, NKT-cells or γδ T-cells or assessing their capacity to modulate phenotype and function of antigen presenting cells such as dendritic cells, monocytes/macrophages or B-cells.

Pharmaceutical Compositions, Formulations and Routes of Administration

In a further aspect, the invention provides pharmaceutical compositions comprising any of the TNF family ligand trimer-containing antigen binding molecules provided herein, e.g., for use in any of the below therapeutic methods. In one embodiment, a pharmaceutical composition comprises any of the TNF family ligand trimer-containing antigen binding molecules provided herein and at least one pharmaceutically acceptable excipient. In another embodiment, a pharmaceutical composition comprises any of the TNF family ligand trimer-containing antigen binding molecules provided herein and at least one additional therapeutic agent, e.g., as described below.

Pharmaceutical compositions of the present invention comprise a therapeutically effective amount of one or more TNF family ligand trimer-containing antigen binding molecules dissolved or dispersed in a pharmaceutically acceptable excipient. The phrases "pharmaceutical or pharmacologically acceptable" refers to molecular entities and compositions that are generally non-toxic to recipients at the dosages and concentrations employed, i.e. do not produce an adverse, allergic or other untoward reaction when administered to an animal, such as, for example, a human, as appropriate. The preparation of a pharmaceutical composition that contains at least one TNF family ligand trimer-containing antigen binding molecule and optionally an additional active ingredient will be known to those of skill in the art in light of the present disclosure, as exemplified by Remington's Pharmaceutical Sciences, 18th Ed. Mack Printing Company, 1990, incorporated herein by reference. In particular, the compositions are lyophilized formulations or aqueous solutions. As used herein, "pharmaceutically acceptable excipient" includes any and all solvents, buffers, dispersion media, coatings, surfactants, antioxidants, preservatives (e.g. antibacterial agents, antifungal agents), isotonic agents, salts, stabilizers and combinations thereof, as would be known to one of ordinary skill in the art.

Parenteral compositions include those designed for administration by injection, e.g. subcutaneous, intradermal, intralesional, intravenous, intraarterial intramuscular, intrathecal or intraperitoneal injection. For injection, the TNF family ligand trimer-containing antigen binding molecules of the invention may be formulated in aqueous solutions, preferably in physiologically compatible buffers such as Hanks' solution, Ringer's solution, or physiological saline buffer. The solution may contain formulatory agents such as suspending, stabilizing and/or dispersing agents. Alternatively, the fusion proteins may be in powder form for constitution with a suitable vehicle, e.g., sterile pyrogen-free water, before use. Sterile injectable solutions are prepared by incorporating the fusion proteins of the invention in the required amount in the appropriate solvent with various of the other ingredients enumerated below, as required. Sterility may be readily accomplished, e.g., by filtration through sterile filtration membranes. Generally, dispersions are prepared by incorporating the various sterilized active ingredients into a sterile vehicle which contains the basic dispersion medium and/or the other ingredients. In the case of sterile powders for the preparation of sterile injectable solutions, suspensions or emulsion, the preferred methods of preparation are vacuum-drying or freeze-drying techniques which yield a powder of the active ingredient plus any additional desired ingredient from a previously sterile-filtered liquid medium thereof. The liquid medium should be suitably buffered if necessary and the liquid diluent first rendered isotonic prior to injection with sufficient saline or glucose. The composition must be stable under the conditions of manufacture and storage, and preserved against the contaminating action of microorganisms, such as bacteria and fungi. It will be appreciated that endotoxin contamination should be kept minimally at a safe level, for example, less that 0.5 ng/mg protein. Suitable pharmaceutically acceptable excipients include, but are not limited to: buffers such as phosphate, citrate, and other organic acids; antioxidants including ascorbic acid and methionine; preservatives (such as octadecyldimethylbenzyl ammonium chloride; hexamethonium chloride; benzalkonium chloride; benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g. Zn-protein complexes); and/or non-ionic surfactants such as polyethylene glycol (PEG). Aqueous injection suspensions may contain compounds which increase the viscosity of the suspension, such as sodium carboxymethyl cellulose, sorbitol, dextran, or the like. Optionally, the suspension may also contain suitable stabilizers or agents which increase the solubility of the compounds to allow for the preparation of highly concentrated solutions. Additionally, suspensions of the active compounds may be prepared as appropriate oily injection suspensions. Suitable lipophilic solvents or vehicles include fatty oils such as sesame oil, or synthetic fatty acid esters, such as ethyl cleats or triglycerides, or liposomes.

Active ingredients may be entrapped in microcapsules prepared, for example, by coacervation techniques or by interfacial polymerization, for example, hydroxymethylcellulose or gelatin-microcapsules and poly-(methylmethacylate) microcapsules, respectively, in colloidal drug delivery systems (for example, liposomes, albumin microspheres, microemulsions, nano-particles and nanocapsules) or in macroemulsions. Such techniques are disclosed in Remington's Pharmaceutical Sciences (18th Ed. Mack Printing Company, 1990). Sustained-release preparations may be prepared. Suitable examples of sustained-release preparations include semipermeable matrices of solid hydrophobic polymers containing the polypeptide, which matrices are in the form of shaped articles, e.g. films, or microcapsules. In particular embodiments, prolonged absorption of an injectable composition can be brought about by the use in the compositions of agents delaying absorption, such as, for example, aluminum monostearate, gelatin or combinations thereof Exemplary pharmaceutically acceptable excipients herein further include insterstitial drug dispersion agents such as soluble neutral-active hyaluronidase glycoproteins (sHASEGP), for example, human soluble PH-20 hyaluronidase glycoproteins, such as rHuPH20 (HYLENEX®, Baxter International, Inc.). Certain exemplary sHASEGPs and methods of use, including rHuPH20, are described in US Patent Publication Nos. 2005/0260186 and 2006/0104968. In one aspect, a sHASEGP is combined with one or more additional glycosaminoglycanases such as chondroitinases.

Exemplary lyophilized antibody formulations are described in U.S. Pat. No. 6,267,958. Aqueous antibody formulations include those described in U.S. Pat. No. 6,171,586 and WO2006/044908, the latter formulations including a histidine-acetate buffer.

In addition to the compositions described previously, the fusion proteins may also be formulated as a depot preparation. Such long acting formulations may be administered by implantation (for example subcutaneously or intramuscularly) or by intramuscular injection. Thus, for example, the fusion proteins may be formulated with suitable polymeric or hydrophobic materials (for example as an emulsion in an acceptable oil) or ion exchange resins, or as sparingly soluble derivatives, for example, as a sparingly soluble salt.

Pharmaceutical compositions comprising the fusion proteins of the invention may be manufactured by means of conventional mixing, dissolving, emulsifying, encapsulating, entrapping or lyophilizing processes. Pharmaceutical compositions may be formulated in conventional manner using one or more physiologically acceptable carriers, diluents, excipients or auxiliaries which facilitate processing of the proteins into preparations that can be used pharmaceutically. Proper formulation is dependent upon the route of administration chosen.

The TNF family ligand trimer-containing antigen binding molecules may be formulated into a composition in a free acid or base, neutral or salt form. Pharmaceutically acceptable salts are salts that substantially retain the biological activity of the free acid or base. These include the acid addition salts, e.g. those formed with the free amino groups of a proteinaceous composition, or which are formed with inorganic acids such as for example, hydrochloric or phosphoric acids, or such organic acids as acetic, oxalic, tartaric or mandelic acid. Salts formed with the free carboxyl groups can also be derived from inorganic bases such as for example, sodium, potassium, ammonium, calcium or ferric hydroxides; or such organic bases as isopropylamine, trimethylamine, histidine or procaine. Pharmaceutical salts tend to be more soluble in aqueous and other protic solvents than are the corresponding free base forms.

The composition herein may also contain more than one active ingredients as necessary for the particular indication being treated, preferably those with complementary activities that do not adversely affect each other. Such active ingredients are suitably present in combination in amounts that are effective for the purpose intended.

The formulations to be used for in vivo administration are generally sterile. Sterility may be readily accomplished, e.g., by filtration through sterile filtration membranes.

Therapeutic Methods and Compositions

Any of the TNF family ligand trimer-containing antigen binding molecules provided herein may be used in therapeutic methods.

For use in therapeutic methods, TNF family ligand trimer-containing antigen binding molecules of the invention can be formulated, dosed, and administered in a fashion consistent with good medical practice. Factors for consideration in this context include the particular disorder being treated, the particular mammal being treated, the clinical condition of the individual patient, the cause of the disorder, the site of delivery of the agent, the method of administration, the scheduling of administration, and other factors known to medical practitioners.

In one aspect, TNF family ligand trimer-containing antigen binding molecules of the invention for use as a medicament are provided. In further aspects, TNF family ligand trimer-containing antigen binding molecules of the invention for use in treating a disease, in particular for use in the treatment of cancer, are provided. In certain aspects, TNF family ligand trimer-containing antigen binding molecules of the invention for use in a method of treatment are provided. In one aspect, the invention provides a TNF family ligand trimer-containing antigen binding molecule as described herein for use in the treatment of a disease in an individual in need thereof. In certain aspects, the invention provides a TNF family ligand trimer-containing antigen binding molecule for use in a method of treating an individual having a disease comprising administering to the individual a therapeutically effective amount of the fusion protein. In certain aspects, the disease to be treated is cancer. Examples of cancers include solid tumors, bladder cancer, renal cell carcinoma, brain cancer, head and neck cancer, pancreatic cancer, lung cancer, breast cancer, ovarian cancer, uterine cancer, cervical cancer, endometrial cancer, esophageal cancer, colon cancer, colorectal cancer, rectal cancer, gastric cancer, prostate cancer, blood cancer, skin cancer, squamous cell carcinoma, bone cancer, and kidney cancer, melanoma, B-cell lymphoma, B-cell leukemia, non-Hodgkin lymphoma and acute lymphoblastic leukemia. Thus, a TNF family ligand trimer-containing antigen binding molecule as described herein for use in the treatment of cancer is provided. The subject, patient, or "individual" in need of treatment is typically a mammal, more specifically a human.

In another aspect, provided is a TNF family ligand trimer-containing antigen binding molecule as described herein for use in the treatment of infectious diseases, in particular for the treatment of viral infections. In a further aspect, provided is a TNF family ligand trimer-containing antigen binding molecule as described herein for use in the treatment of autoimmune diseases such as for example Lupus disease.

In one aspect, provided is a TNF family ligand trimer-containing antigen binding molecule according to the invention for use in treating head and neck squamous cell carcinoma (HNSCC), breast cancer, colorectal cancer (CRC), pancreatic cancer (PAC), gastric cancer, non-small-cell lung carcinoma (NSCLC) and Mesothelioma, wherein the target cell antigen is FAP.

In a further aspect, the invention relates to the use of a TNF family ligand trimer-containing antigen binding molecule in the manufacture or preparation of a medicament for the treatment of a disease in an individual in need thereof. In one aspect, the medicament is for use in a method of treating a disease comprising administering to an individual having the disease a therapeutically effective amount of the medicament. In certain embodiments the disease to be treated is a proliferative disorder, particularly cancer. Thus, in one aspect, the invention relates to the use of a TNF family ligand trimer-containing antigen binding molecule of the invention in the manufacture or preparation of a medicament for the treatment of cancer. Examples of cancers include solid tumors, bladder cancer, renal cell carcinoma, brain cancer, head and neck cancer, pancreatic cancer, lung cancer, breast cancer, ovarian cancer, uterine cancer, cervical cancer, endometrial cancer, esophageal cancer, colon cancer, colorectal cancer, rectal cancer, gastric cancer, prostate cancer, blood cancer, skin cancer, squamous cell carcinoma, bone cancer, and kidney cancer, melanoma, B-cell lymphoma, B-cell leukemia, non-Hodgkin lymphoma and acute lymphoblastic leukemia. Other cell proliferation disorders that can be treated using a TNF family ligand trimer-containing antigen binding molecule of the present invention include, but are not limited to neoplasms located in the: abdomen, bone, breast, digestive system, liver, pancreas, peritoneum, endocrine glands (adrenal, parathyroid, pituitary, testicles, ovary, thymus, thyroid), eye, head and neck, nervous system (central and peripheral), lymphatic system, pelvic, skin, soft tissue, spleen, thoracic region, and urogenital system. Also included are pre-cancerous conditions or lesions and cancer metastases. In certain embodiments the cancer is chosen from the group consisting of renal cell cancer, skin cancer, lung cancer, colorectal cancer, breast cancer, brain cancer, head and neck cancer. A skilled artisan may recognize that in some cases the TNF family ligand trimer-containing antigen binding molecule may not provide a cure but may only provide partial benefit. In some aspects, a physiological change having some benefit is also considered therapeutically beneficial. Thus, in some aspects, an amount of TNF family ligand trimer-containing antigen binding molecule that provides a physiological change is considered an "effective amount" or a "therapeutically effective amount".

In a further aspect, the invention relates to the use of a TNF family ligand trimer-containing antigen binding molecule as described herein in the manufacture or preparation of a medicament for the treatment of infectious diseases, in particular for the treatment of viral infections or for the treatment of autoimmune diseases, for example Lupus disease.

In a further aspect, the invention provides a method for treating a disease in an individual, comprising administering to said individual a therapeutically effective amount of a TNF family ligand trimer-containing antigen binding molecule of the invention. In one aspect a composition is administered to said individual, comprising a fusion protein of the invention in a pharmaceutically acceptable form. In certain aspects, the disease to be treated is a proliferative disorder. In a particular aspect, the disease is cancer. In another aspect, the disease is an infectious disease or an autoimmune disease. In certain aspects, the method further comprises administering to the individual a therapeutically effective amount of at least one additional therapeutic agent, e.g. an anti-cancer agent if the disease to be treated is cancer. An "individual" according to any of the above embodiments may be a mammal, preferably a human.

For the prevention or treatment of disease, the appropriate dosage of a TNF family ligand trimer-containing antigen binding molecule of the invention (when used alone or in combination with one or more other additional therapeutic agents) will depend on the type of disease to be treated, the route of administration, the body weight of the patient, the type of fusion protein, the severity and course of the disease, whether the fusion protein is administered for preventive or therapeutic purposes, previous or concurrent therapeutic interventions, the patient's clinical history and response to the fusion protein, and the discretion of the attending physician. The practitioner responsible for administration will, in any event, determine the concentration of active ingredient(s) in a composition and appropriate dose(s) for the individual subject. Various dosing schedules including but not limited to single or multiple administrations over various time-points, bolus administration, and pulse infusion are contemplated herein.

The TNF family ligand trimer-containing antigen binding molecule is suitably administered to the patient at one time or over a series of treatments. Depending on the type and severity of the disease, about 1 µg/kg to 15 mg/kg (e.g. 0.1 mg/kg-10 mg/kg) of TNF family ligand trimer-containing antigen binding molecule can be an initial candidate dosage for administration to the patient, whether, for example, by one or more separate administrations, or by continuous infusion. One typical daily dosage might range from about 1 µg/kg to 100 mg/kg or more, depending on the factors mentioned above. For repeated administrations over several days or longer, depending on the condition, the treatment would generally be sustained until a desired suppression of disease symptoms occurs. One exemplary dosage of the fusion protein would be in the range from about 0.005 mg/kg to about 10 mg/kg. In other examples, a dose may also comprise from about 1 µg/kg body weight, about 5 µg/kg body weight, about 10 µg/kg body weight, about 50 µg/kg body weight, about 100 µg/kg body weight, about 200 µg/kg body weight, about 350 µg/kg body weight, about 500 µg/kg body weight, about 1 mg/kg body weight, about 5 mg/kg body weight, about 10 mg/kg body weight, about 50 mg/kg body weight, about 100 mg/kg body weight, about 200 mg/kg body weight, about 350 mg/kg body weight, about 500 mg/kg body weight, to about 1000 mg/kg body weight or more per administration, and any range derivable therein. In examples of a derivable range from the numbers listed herein, a range of about 5 mg/kg body weight to about 100 mg/kg body weight, about 5 µg/kg body weight to about 500 mg/kg body weight etc., can be administered, based on the numbers described above. Thus, one or more doses of about 0.5 mg/kg, 2.0 mg/kg, 5.0 mg/kg or 10 mg/kg (or any combination thereof) may be administered to the patient. Such doses may be administered intermittently, e.g. every week or every three weeks (e.g. such that the patient receives from about two to about twenty, or e.g. about six doses of the fusion protein). An initial higher loading dose, followed by one or more lower doses may be administered. However, other dosage regimens may be useful. The progress of this therapy is easily monitored by conventional techniques and assays.

The TNF family ligand trimer-containing antigen binding molecules of the invention will generally be used in an amount effective to achieve the intended purpose. For use to treat or prevent a disease condition, the TNF family ligand trimer-containing antigen binding molecules of the invention, or pharmaceutical compositions thereof, are administered or applied in a therapeutically effective amount. Determination of a therapeutically effective amount is well within the capabilities of those skilled in the art, especially in light of the detailed disclosure provided herein.

For systemic administration, a therapeutically effective dose can be estimated initially from in vitro assays, such as cell culture assays. A dose can then be formulated in animal models to achieve a circulating concentration range that includes the $IC_{50}$ as determined in cell culture. Such information can be used to more accurately determine useful doses in humans.

Initial dosages can also be estimated from in vivo data, e.g., animal models, using techniques that are well known in the art. One having ordinary skill in the art could readily optimize administration to humans based on animal data.

Dosage amount and interval may be adjusted individually to provide plasma levels of the TNF family ligand trimer-containing antigen binding molecules which are sufficient to maintain therapeutic effect. Usual patient dosages for administration by injection range from about 0.1 to 50 mg/kg/day, typically from about 0.5 to 1 mg/kg/day. Therapeutically effective plasma levels may be achieved by administering multiple doses each day. Levels in plasma may be measured, for example, by HPLC.

In cases of local administration or selective uptake, the effective local concentration of the TNF family ligand trimer-containing antigen binding molecule may not be related to plasma concentration. One skilled in the art will be able to optimize therapeutically effective local dosages without undue experimentation.

A therapeutically effective dose of the TNF family ligand trimer-containing antigen binding molecules described herein will generally provide therapeutic benefit without causing substantial toxicity. Toxicity and therapeutic efficacy of a fusion protein can be determined by standard pharmaceutical procedures in cell culture or experimental animals. Cell culture assays and animal studies can be used to determine the $LD_{50}$ (the dose lethal to 50% of a population) and the $ED_{50}$ (the dose therapeutically effective in 50% of a population). The dose ratio between toxic and therapeutic effects is the therapeutic index, which can be expressed as the ratio $LD_{50}/ED_{50}$. TNF family ligand trimer-containing antigen binding molecules that exhibit large therapeutic indices are preferred. In one embodiment, the TNF family ligand trimer-containing antigen binding molecule according to the present invention exhibits a high therapeutic index. The data obtained from cell culture assays and animal studies can be used in formulating a range of dosages suitable for use in humans. The dosage lies preferably within a range of circulating concentrations that include the $ED_{50}$ with little or no toxicity. The dosage may vary within this range depending upon a variety of factors, e.g., the dosage form employed, the route of administration utilized, the condition of the subject, and the like. The exact formulation, route of administration and dosage can be chosen by the individual physician in view of the patient's condition (see, e.g., Fingl et al., 1975, in: The Pharmacological Basis of Therapeutics, Ch. 1, p. 1, incorporated herein by reference in its entirety).

The attending physician for patients treated with fusion proteins of the invention would know how and when to terminate, interrupt, or adjust administration due to toxicity, organ dysfunction, and the like. Conversely, the attending physician would also know to adjust treatment to higher levels if the clinical response were not adequate (precluding toxicity). The magnitude of an administered dose in the management of the disorder of interest will vary with the severity of the condition to be treated, with the route of administration, and the like. The severity of the condition may, for example, be evaluated, in part, by standard prognostic evaluation methods. Further, the dose and perhaps dose frequency will also vary according to the age, body weight, and response of the individual patient.

Other Agents and Treatments

The TNF family ligand trimer-containing antigen binding molecules of the invention may be administered in combination with one or more other agents in therapy. For instance, a fusion protein of the invention may be co-administered with at least one additional therapeutic agent. The term "therapeutic agent" encompasses any agent that can be administered for treating a symptom or disease in an individual in need of such treatment. Such additional therapeutic agent may comprise any active ingredients suitable for the particular indication being treated, preferably those with complementary activities that do not adversely affect each other. In certain embodiments, an additional therapeutic agent is another anti-cancer agent.

Such other agents are suitably present in combination in amounts that are effective for the purpose intended. The effective amount of such other agents depends on the amount of fusion protein used, the type of disorder or treatment, and other factors discussed above. The TNF family ligand trimer-containing antigen binding molecules are generally used in the same dosages and with administration routes as described herein, or about from 1 to 99% of the dosages described herein, or in any dosage and by any route that is empirically/clinically determined to be appropriate.

Such combination therapies noted above encompass combined administration (where two or more therapeutic agents are included in the same or separate compositions), and separate administration, in which case, administration of the TNF family ligand trimer-containing antigen binding molecule of the invention can occur prior to, simultaneously, and/or following, administration of the additional therapeutic agent and/or adjuvant.

Articles of Manufacture

In another aspect of the invention, an article of manufacture containing materials useful for the treatment, prevention and/or diagnosis of the disorders described above is provided. The article of manufacture comprises a container and a label or package insert on or associated with the container. Suitable containers include, for example, bottles, vials, syringes, IV solution bags, etc. The containers may be formed from a variety of materials such as glass or plastic. The container holds a composition which is by itself or combined with another composition effective for treating, preventing and/or diagnosing the condition and may have a sterile access port (for example the container may be an intravenous solution bag or a vial having a stopper that is pierceable by a hypodermic injection needle). At least one active agent in the composition is a TNF ligand trimer-containing antigen binding molecule of the invention.

The label or package insert indicates that the composition is used for treating the condition of choice. Moreover, the article of manufacture may comprise (a) a first container with a composition contained therein, wherein the composition comprises a TNF ligand trimer-containing antigen binding molecule of the invention; and (b) a second container with a composition contained therein, wherein the composition comprises a further cytotoxic or otherwise therapeutic agent. The article of manufacture in this embodiment of the invention may further comprise a package insert indicating that the compositions can be used to treat a particular condition.

Alternatively, or additionally, the article of manufacture may further comprise a second (or third) container comprising a pharmaceutically-acceptable buffer, such as bacteriostatic water for injection (BWFI), phosphate-buffered saline, Ringer's solution and dextrose solution. It may further include other materials desirable from a commercial and user standpoint, including other buffers, diluents, filters, needles, and syringes.

TABLE C (Sequences):

| SEQ ID NO: | Name | Sequence |
|---|---|---|
| 1 | Human (hu) 4-1BBL (71-254) | REGPELSPDDPAGLLDLRQGMFAQLVAQNVLLIDGP<br>LSWYSDPGLAGVSLTGGLSYKEDTKELVVAKAGVY<br>YVFFQLELRRVVAGEGSGSVSLALHLQPLRSAAGAA<br>ALALTVDLPPASSEARNSAFGFQGRLLHLSAGQRLG<br>VHLHTEARARHAWQLTQGATVLGLFRVTPEIPAGLP<br>SPRSE |
| 2 | hu 4-1BBL (85-254) | LDLRQGMFAQLVAQNVLLIDGPLSWYSDPGLAGVSL<br>TGGLSYKEDTKELVVAKAGVYYVFFQLELRRVVAG<br>EGSGSVSLALHLQPLRSAAGAAALALTVDLPPASSEA<br>RNSAFGFQGRLLHLSAGQRLGVHLHTEARARHAWQ<br>LTQGATVLGLFRVTPEIPAGLPSPRSE |
| 3 | hu 4-1BBL (80-254) | DPAGLLDLRQGMFAQLVAQNVLLIDGPLSWYSDPGL<br>AGVSLTGGLSYKEDTKELVVAKAGVYYVFFQLELRR<br>VVAGEGSGSVSLALHLQPLRSAAGAAALALTVDLPP<br>ASSEARNSAFGFQGRLLHLSAGQRLGVHLHTEARAR<br>HAWQLTQGATVLGLFRVTPEIPAGLPSPRSE |
| 4 | hu 4-1BBL (52-254) | PWAVSGARASPGSAASPRLREGPELSPDDPAGLLDLR<br>QGMFAQLVAQNVLLIDGPLSWYSDPGLAGVSLTGGL<br>SYKEDTKELVVAKAGVYYVFFQLELRRVVAGEGSG<br>SVSLALHLQPLRSAAGAAALALTVDLPPASSEARNSA<br>FGFQGRLLHLSAGQRLGVHLHTEARARHAWQLTQG<br>ATVLGLFRVTPEIPAGLPSPRSE |
| 5 | dimeric hu 4-1BBL (71-254) connected by (G$_4$S)$_2$ linker | REGPELSPDDPAGLLDLRQGMFAQLVAQNVLLIDGP<br>LSWYSDPGLAGVSLTGGLSYKEDTKELVVAKAGVY<br>YVFFQLELRRVVAGEGSGSVSLALHLQPLRSAAGAA<br>ALALTVDLPPASSEARNSAFGFQGRLLHLSAGQRLG<br>VHLHTEARARHAWQLTQGATVLGLFRVTPEIPAGLP<br>SPRSEGGGGSGGGGSREGPELSPDDPAGLLDLRQGM<br>FAQLVAQNVLLIDGPLSWYSDPGLAGVSLTGGLSYK<br>EDTKELVVAKAGVYYVFFQLELRRVVAGEGSGSVSL<br>ALHLQPLRSAAGAAALALTVDLPPASSEARNSAFGF<br>QGRLLHLSAGQRLGVHLHTEARARHAWQLTQGATV<br>LGLFRVTPEIPAGLPSPRSE |
| 6 | monomeric hu 4-1BBL (71-254) plus (G$_4$S)$_2$ linker | REGPELSPDDPAGLLDLRQGMFAQLVAQNVLLIDGP<br>LSWYSDPGLAGVSLTGGLSYKEDTKELVVAKAGVY<br>YVFFQLELRRVVAGEGSGSVSLALHLQPLRSAAGAA<br>ALALTVDLPPASSEARNSAFGFQGRLLHLSAGQRLG<br>VHLHTEARARHAWQLTQGATVLGLFRVTPEIPAGLP<br>SPRSEGGGGSGGGGS |
| 7 | FAP(28H1) CDR-H1 | SHAMS |
| 8 | FAP(28H1) CDR-H2 | AIWASGEQYYADSVKG |
| 9 | FAP(28H1) CDR-H3 | GWLGNFDY |
| 10 | FAP(28H1) CDR-L1 | RASQSVSRSYLA |
| 11 | FAP(28H1) CDR-L2 | GASTRAT |
| 12 | FAP(28H1) CDR-L3 | QQGQVIPPT |
| 13 | (G$_4$S)$_2$ | GGGGSGGGGS |
| 14 | dimeric hu 4-1BBL (71-254)-CH1 Fc knob chain | REGPELSPDDPAGLLDLRQGMFAQLVAQNVLLIDGP<br>LSWYSDPGLAGVSLTGGLSYKEDTKELVVAKAGVY<br>YVFFQLELRRVVAGEGSGSVSLALHLQPLRSAAGAA<br>ALALTVDLPPAS SEARNSAFGFQGRLLHLSAGQRLG<br>VHLHTEARARHAWQLTQGATVLGLFRVTPEIPAGLP<br>SPRSEGGGGSGGGGSREGPELSPDDPAGLLDLRQGM<br>FAQLVAQNVLLIDGPLSWYSDPGLAGVSLTGGLSYK<br>EDTKELVVAKAGVYYVFFQLELRRVVAGEGSGSVSL<br>ALHLQPLRSAAGAAALALTVDLPPASSEARNSAFGF<br>QGRLLHLSAGQRLGVHLHTEARARHAWQLTQGATV<br>LGLFRVTPEIPAGLPSPRSEGGGGSGGGGSASTKGPS<br>VFPLAPSSKSTSGGTAALGCLVKDYFPEPVTVSWNSG<br>ALTSGVHTFPAVLQSSGLYSLSSVVTVPSSSLGTQTYI<br>CNVNHKPSNTKVDKKVEPKSCDKTHTCPPCPAPEAA<br>GGPSVFLFPPKPKDTLMISRTPEVTCVVVDVSHEDPE<br>VKFNWYVDGVEVHNAKTKPREEQYNSTYRVVSVLT |

TABLE C-continued (Sequences):

| SEQ ID NO: | Name | Sequence |
|---|---|---|
| | | VLHQDWLNGKEYKCKVSNKALGAPIEKTISKAKGQP REPQVYTLPPCRDELTKNQVSLWCLVKGFYPSDIAV EWESNGQPENNYKTTPPVLDSDGSFFLYSKLTVDKS RWQQGNVFSCSVMHEALHNHYTQKSLSLSPGK |
| 15 | monomeric hu 4-1BBL (71-254)-CL | REGPELSPDDPAGLLDLRQGMFAQLVAQNVLLIDGP LSWYSDPGLAGVSLTGGLSYKEDTKELVVAKAGVY YVFFQLELRRVVAGEGSGSVSLALHLQPLRSAAGAA ALALTVDLPPASSEARNSAFGFQGRLLHLSAGQRLG VHLHTEARARHAWQLTQGATVLGLFRVTPEIPAGLP SPRSEGGGGSGGGGSRTVAAPSVFIFPPSDEQLKSGT ASVVCLLNNFYPREAKVQWKVDNALQSGNSQESVT EQDSKDSTYSLSSTLTLSKADYEKHKVYACEVTHQG LSSPVTKSFNRGEC |
| 16 | FAP(28H1) VH | EVQLLESGGGLVQPGGSLRLSCAASGFTFSSHA MSWVRQAPGKGLEWVSAIWASGEQYYADSVK GRFTISRDNSKNTLYLQMNSLRAEDTAVYYCAK GWLGNFDYWGQGTLVTVSS |
| 17 | FAP(28H1) VL | EIVLTQSPGTLSLSPGERATLSCRASQSVSRSYLA WYQQKPGQAPRLLIIGASTRATGIPDRFSGSGSG TDFTLTISRLEPEDFAVYYCQQGQVIPPTFGQGT KVEIK |
| 18 | anti-FAP(28H1) Fc hole chain | see Table 2 |
| 19 | anti-FAP(28H1) light chain | see Table 2 |
| 20 | Human (hu) FAP | UniProt no. Q12884 |
| 21 | hu FAP ectodomain + poly-lys-tag + his$_6$-tag | RPSRVHNSEENTMRALTLKDILNGTFSYKTFFPNWIS GQEYLHQSADNNIVLYNIETGQSYTILSNRTMKSVNA SNYGLSPDRQFVYLESDYSKLWRYSYTATYYIYDLS NGEFVRGNELPRPIQYLCWSPVGSKLAYVYQNNIYL KQRPGDPPFQITFNGRENKIFNGIPDWVYEEEMLATK YALWWSPNGKFLAYAEFNDTDIPVIAYSYYGDEQYP RTINIPYPKAGAKNPVVRIFIIDTTYPAYVGPQEVPVP AMIASSDYYFSWLTWVTDERVCLQWLKRVQNVSVL SICDFREDWQTWDCPKTQEHIEESRTGWAGGFFVST PVFSYDAISYYKIFSDKDGYKHIHYIKDTVENAIQITS GKWEAINIFRVTQDSLFYSSNEFEEYPGRRNIYRISIGS YPPSKKCVTCHLRKERCQYYTASFSDYAKYYALVCY GPGIPISTLHDGRTDQEIKILEENKELENALKNIQLPKE EIKKLEVDEITLWYKMILPPQFDRSKKYPLLIQVYGG PCSQSVRSVFAVNWISYLASKEGMVIALVDGRGTAF QGDKLLYAVYRKLGVYEVEDQITAVRKFIEMGFIDE KRIAIWGWSYGGYVSSLALASGTGLFKCGIAVAPVSS WEYYASVYTERFMGLPTKDDNLEHYKNSTVMARAE YFRNVDYLLIHGTADDNVHFQNSAQIAKALVNAQV DFQAMWYSDQNHGLSGLSTNHLYTHMTHFLKQCFS LSDGKKKKKGHHHHHH |
| 22 | nucleotide sequence hu FAP ectodomain + poly-lys-tag + his$_6$-tag | CGCCCTTCAAGAGTTCATAACTCTGAAGAAAATAC AATGAGAGCACTCACACTGAAGGATATTTTAAATG GAACATTTTCTTATAAAACATTTTTTCCAAACTGGA TTTCAGGACAAGAATATCTTCATCAATCTGCAGAT AACAATATAGTACTTTATAATATTGAAACAGGACA ATCATATACCATTTTGAGTAATAGAACCATGAAAA GTGTGAATGCTTCAAATTACGGCTTATCACCTGAT CGGCAATTTGTATATCTAGAAAGTGATTATTCAAA GCTTTGGAGATACTCTTACACAGCAACATATTACA TCTATGACCTTAGCAATGGAGAATTTGTAAGAGGA AATGAGCTTCCTCGTCCAATTCAGTATTTATGCTGG TCGCCTGTTGGGAGTAAATTAGCATATGTCTATCA AAACAATATCTATTTGAAACAAAGACCAGGAGAT CCACCTTTTCAAATAACATTTAATGGAAGAGAAAA TAAAATATTTAATGGAATCCCAGACTGGGTTTATG AAGAGGAAATGCTTGCTACAAAATATGCTCTCTGG TGGTCTCCTAATGGAAAATTTTTGGCATATGCGGA ATTTAATGATACGGATATACCAGTTATTGCCTATTC CTATTATGGCGATGAACAATATCCTAGAACAATAA ATATTCCATAC CCAAAGGCTGGAGCTAAGAATCCC GTTGTTCGGATATTTATTATCGATACCACTTACCCT |

TABLE C-continued (Sequences):

| SEQ ID NO: Name | Sequence |
|---|---|
| | GCGTATGTAGGTCCCCAGGAAGTGCCTGTTCCAGC AATGATAGCCTCAAGTGATTATTATTTCAGTTGGC TCACGTGGGTTACTGATGAACGAGTATGTTTGCAG TGGCTAAAAAGAGTCCAGAATGTTTCGGTCCTGTC TATATGTGACTTCAGGGAAGACTGGCAGACATGGG ATTGTCCAAAGACCCAGGAGCATATAGAAGAAAG CAGAACTGGATGGGCTGGTGGATTCTTTGTTTCAA CACCAGTTTTCAGCTATGATGCCATTTCGTACTACA AAATATTTAGTGACAAGGATGGCTACAAACATATT CACTATATCAAAGACACTGTGGAAAATGCTATTCA AATTACAAGTGGCAAGTGGGAGGCCATAAATATA TTCAGAGTAACACAGGATTCACTGTTTTATTCTAG CAATGAATTTGAAGAATACCCTGGAAGAAGAAAC ATCTACAGAATTAGCATTGGAAGCTATCCTCCAAG CAAGAAGTGTGTTACTTGCCATCTAAGGAAAGAAA GGTGCCAATATTACACAGCAAGTTTCAGCGACTAC GCCAAGTACTATGCACTTGTCTGCTACGGCCCAGG CATCCCCATTTCCACCCTTCATGATGGACGCACTG ATCAAGAAATTAAAATCCTGGAAGAAACAAGGA ATTGGAAATGCTTTGAAAAATATCCAGCTGCCTA AAGAGGAAATTAAGAAACTTGAAGTAGATGAAAT TACTTTATGGTACAAGATGATTCTTCCTCCTCAATT TGACAGATCAAAGAAGTATCCCTTGCTAATTCAAG TGTATGGTGGTCCCTGCAGTCAGAGTGTAAGGTCT GTATTTGCTGTTAATTGGATATCTTATCTTGCAAGT AAGGAAGGGATGGTCATTGCCTTGGTGGATGGTCG AGGAACAGCTTTCCAAGGTGACAAACTCCTCTATG CAGTGTATCGAAAGCTGGGTGTTTATGAAGTTGAA GACCAGATTACAGCTGTCAGAAAATTCATAGAAAT GGGTTTCATTGATGAAAAAAGAATAGCCATATGGG GCTGGTCCTATGGAGGATACGTTTCATCACTGGCC CTTGCATCTGGAACTGGTCTTTTCAAATGTGGTATA GCAGTGGCTCCAGTCTCCAGCTGGGAATATTACGC GTCTGTCTACACAGAGAGATTCATGGGTCTCCCAA CAAAGGATGATAATCTTGAGCACTATAAGAATTCA ACTGTGATGGCAAGAGCAGAATATTTCAGAAATGT AGACTATCTTCTCATCCACGGAACAGCAGATGATA ATGTGCACTTTCAAAACTCAGCACAGATTGCTAAA GCTCTGGTTAATGCACAAGTGGATTTCCAGGCAAT GTGGTACTCTGACCAGAACCACGGCTTATCCGGCC TGTCCACGAACCACTTATACACCCACATGACCCAC TTCCTAAAGCAGTGTTTCTCTTTGTCAGACGGCAA AAAGAAAAGAAAAAGGGCCACCACCATCACCAT CAC |
| 23 mouse FAP | UniProt no. P97321 |
| 24 Murine FAP ectodomain + poly-lys-tag + his$_6$-tag | RPSRVYKPEGNTKRALTLKDILNGTFSYKTYFPNWIS EQEYLHQSEDDNIVFYNIETRESYIILSNSTMKSVNAT DYGLSPDRQFVYLESDYSKLWRYSYTATYYIYDLQN GEFVRGYELPRPIQYLCWSPVGSKLAYVYQNNIYLK QRPGDPPFQITYTGRENRIFNGIPDWVYEEEMLATKY ALWWSPDGKFLAYVEFNDSDIPIIAYSYYGDGQYPR TINIPYPKAGAKNPVVRVFIVDTTYPHHVGPMEVPVP EMIASSDYYFSWLTWVSSERVCLQWLKRVQNVSVL SICDFREDWHAWECPKNQEHVEESRTGWAGGFFVST PAFSQDATSYYKIFSDKDGYKHIHYIKDTVENAIQITS GKWEAIYIFRVTQDSLFYSSNEFEGYPGRRNIYRISIG NSPPSKKCVTCHLRKERCQYYTASFSYKAKYYALVC YGPGLPISTLHDGRTDQEIQVLEENKELENSLRNIQLP KVEIKKLKDGGLTFWYKMILPPQFDRSKKYPLLIQVY GGPCSQSVKSVFAVNWITYLASKEGIVIALVDGRGTA FQGDKFLHAVYRKLGVYEVEDQLTAVRKFIEMGFID EERIAIWGWSYGGYVSSLALASGTGLFKCGIAVAPVS SWEYYASIYSERFMGLPTKDDNLEHYKNSTVMARA EYFRNVDYLLIHGTADDNVHFQNSAQIAKALVNAQV DFQAMWYSDQNHGILSGRSQNHLYTHMTHFLKQCF SLSDGKKKKKGHHHHHH |
| 25 nucleotide sequence Murine FAP ectodomain + poly-lys-tag + his$_6$-tag | CGTCCCTCAAGAGTTTACAAACCTGAAGGAAACAC AAAGAGAGCTCTTACCTTGAAGGATATTTTAAATG GAACATTCTCATATAAAACATATTTTCCCAACTGG ATTTCAGAACAAGAATATCTTCATCAATCTGAGGA TGATAACATAGTATTTTATAATATTGAAACAAGAG AATCATATATCATTTTGAGTAATAGCACCATGAAA |

TABLE C-continued (Sequences):

| SEQ ID NO: Name | Sequence |
|---|---|
| | AGTGTGAATGCTACAGATTATGGTTTGTCACCTGA<br>TCGGCAATTTGTGTATCTAGAAAGTGATTATTCAA<br>AGCTCTGGCGATATTCATACACAGCGACATACTAC<br>ATCTACGACCTTCAGAATGGGGAATTTGTAAGAGG<br>ATACGAGCTCCCTCGTCCAATTCAGTATCTATGCT<br>GGTCGCCTGTTGGGAGTAAATTAGCATATGTATAT<br>CAAAACAATATTTATTTGAAACAAAGACCAGGAG<br>ATCCACCTTTTCAAATAACTTATACTGGAAGAGAA<br>AATAGAATATTTAATGGAATACCAGACTGGGTTTA<br>TGAAGAGGAAATGCTTGCCACAAAATATGCTCTTT<br>GGTGGTCTCCAGATGGAAAATTTTTGGCATATGTA<br>GAATTTAATGATTCAGATATACCAATTATTGCCTA<br>TTCTTATTATGGTGATGGACAGTATCCTAGAACTA<br>TAAATATTCCATATCCAAAGGCTGGGGCTAAGAAT<br>CCGGTTGTTCGTGTTTTATTGTTGACACCACCTAC<br>CCTCACCACGTGGGCCCAATGGAAGTGCCAGTTCC<br>AGAAATGATAGCCTCAAGTGACTATTATTTCAGCT<br>GGCTCACATGGGTGTCCAGTGAACGAGTATGCTTG<br>CAGTGGCTAAAAAGAGTGCAGAATGTCTCAGTCCT<br>GTCTATATGTGATTTCAGGGAAGACTGGCATGCAT<br>GGGAATGTCCAAAGAACCAGGAGCATGTAGAAGA<br>AAGCAGAACAGGATGGGCTGGTGGATTCTTTGTTT<br>CGACACCAGCTTTTAGCCAGGATGCCACTTCTTAC<br>TACAAAATATTTAGCGACAAGGATGGTTACAAACA<br>TATTCACTACATCAAAGACACTGTGGAAAATGCTA<br>TTCAAATTACAAGTGGCAAGTGGGAGGCCATATAT<br>ATATTCCGCGTAACACAGGATTCACTGTTTTATTCT<br>AGCAATGAATTTGAAGGTTACCCTGGAAGAAGAA<br>ACATCTACAGAATTAGCATTGGAAACTCTCCTCCG<br>AGCAAGAAGTGTGTTACTTGCCATCTAAGGAAAGA<br>AAGGTGCCAATATTACACAGCAAGTTTCAGCTACA<br>AAGCCAAGTACTATGCCACTCGTCTGCTATGGCCCT<br>GGCCTCCCCATTTCCACCCTCCATGATGGCCGCAC<br>AGACCAAGAAATACAAGTATTAGAAGAAAACAAA<br>GAACTGGAAAATTCTCTGAGAAATATCCAGCTGCC<br>TAAAGTGGAGATTAAGAAGCTCAAAGACGGGGGA<br>CTGACTTTCTGGTACAAGATGATTCTGCCTCCTCAG<br>TTTGACAGATCAAAGAAGTACCCTTTGCTAATTCA<br>AGTGTATGGTGGTCCTTGTAGCCAGAGTGTTAAGT<br>CTGTGTTTGCTGTTAATTGGATAACTTATCTCGCAA<br>GTAAGGAGGGGATAGTCATTGCCCTGGTAGATGGT<br>CGGGGCACTGCTTTCCAAGGTGACAAATTCCTGCA<br>TGCCGTGTATCGAAAACTGGGTGTATATGAAGTTG<br>AGGACCAGCTCACAGCTGTCAGAAAATTCATAGA<br>AATGGGTTTCATTGATGAAGAAAGAATAGCCATAT<br>GGGGCTGGTCCTACGGAGGTTATGTTTCATCCCTG<br>GCCCTTGCATCTGGAACTGGTCTTTTCAAATGTGG<br>CATAGCAGTGGCTCCAGTCTCCAGCTGGGAATATT<br>ACGCATCTATCTACTCAGAGAGATTCATGGGCCTC<br>CCAACAAAGGACGACAATCTCGAACACTATAAAA<br>ATTCAACTGTGATGGCAAGAGCAGAATATTTCAGA<br>AATGTAGACTATCTTCTCATCCACGGAACAGCAGA<br>TGATAATGTGCACTTTCAGAACTCAGCACAGATTG<br>CTAAAGCTTTGGTTAATGCACAAGTGGATTTCCAG<br>GCGATGTGGTACTCTGACCAGAACCATGGTATATT<br>ATCTGGGCGCTCCCAGAATCATTTATATACCCACA<br>TGACGCACTTCCTCAAGCAATGCTTTTCTTTATCAG<br>ACGGCAAAAGAAAAAGAAAAAGGGCCACCACCA<br>TCACCATCAC |
| 26 | Cynomolgus FAP ectodomain + poly-lys-tag + his6-tag | RPPRVHNSEENTMRALTLKDILNGTFSYKTFFPNWIS<br>GQEYLHQSADNNIVLYNIETGQSYTILSNRTMKSVNA<br>SNYGLSPDRQFVYLESDYSKLWRYSYTATYYWDLS<br>NGEFVRGNELPRPIQYLCWSPVGSKLAYVYQNNIYL<br>KQRPGDPPFQITFNGRENKIFNGIPDWVYEEEMLATK<br>YALWWSPNGKFLAYAEFNDTDIPVIAYSYYGDEQYP<br>RTINIPYPKAGAKNPFVRIFIIDTTYPAYVGPQEVPVP<br>AMIASSDYYFSWLTWVTDERVCLQWLKRVQNVSVL<br>SICDFREDWQTWDCPKTQEHIEESRTGWAGGFFVST<br>PVFSYDAISYYKIFSDKDGYKHIHYIKDTVENAIQITS<br>GKWEAINIFRVTQDSLFYSSNEFEDYPGRRNIYRISIG<br>SYPPSKKCVTCHLRKERCQYYTASFSDYAKYYALVC<br>YGPGIPISTLHDGRTDQEIKILEENKELENALKNIQLP<br>KEEIKKLEVDEITLWYKMILPPQFDRSKKYPLLIQVY<br>GGPCSQSVRSVFAVNWISYLASKEGMVIALVDGRGT |

TABLE C-continued (Sequences):

| SEQ ID NO: | Name | Sequence |
|---|---|---|
| | | AFQGDKLLYAVYRKLGVYEVEDQITAVRKFIEMGFI DEKRIAIWGWSYGGYVSSLALASGTGLFKCGIAVAP VSSWEYYASVYTERFMGLPTKDDNLEHYKNSTVMA RAEYFRNVDYLLIHGTADDNVHFQNSAQIAKALVNA QVDFQAMWYSDQNHGLSGLSTNHLYTHMTHFLKQ CFSLSDGKKKKKKGHHHHHH |
| 27 | nucleotide sequence Cynomolgus FAP ectodomain + poly-lys-tag + his$_6$-tag | CGCCCTCCAAGAGTTCATAACTCTGAAGAAAATAC AATGAGAGCACTCACACTGAAGGATATTTTAAATG GGACATTTTCTTATAAAACATTTTTTCCAAACTGGA TTTCAGGACAAGAATATCTTCATCAATCTGCAGAT AACAATATAGTACTTTATAATATTGAAACAGGACA ATCATATACCATTTTGAGTAACAGAACCATGAAAA GTGTGAATGCTTCAAATTATGGCTTATCACCTGAT CGGCAATTTGTATATCTAGAAAGTGATTATTCAAA GCTTTGGAGATACTCTTACACAGCAACATATTACA TCTATGACCTTAGCAATGGAGAATTTGTAAGAGGA AATGAGCTTCCTCGTCCAATTCAGTATTATGCTGG TCGCCTGTTGGGAGTAAATTAGCATATGTCTATCA AAACAATATCTATTTGAAACAAAGACCAGGAGAT CCACCTTTTCAAATAACATTTAATGGAAGAGAAAA TAAAATATTTAATGGAATCCCAGACTGGGTTTATG AAGAGGAAATGCTTGCTACAAAATATGCTCTCTGG TGGTCTCCTAATGGAAAATTTTTGGCATATGCGGA ATTTAATGATACAGATATACCAGTTATTGCCTATTC CTATTATGGCGATGAACAATATCCCAGAACAATAA ATATTCCATACCCAAAGGCCGGAGCTAAGAATCCT TTTGTTCGGATATTTATTATCGATACCACTTACCCT GCGTATGTAGGTCCCCAGGAAGTGCCTGTTCCAGC AATGATAGCCTCAAGTGATTATTATTTCAGTTGGC TCACGTGGGTTACTGATGAACGAGTATGTTTGCAG TGGCTAAAAAGAGTCCAGAATGTTTCGGTCTTGTC TATATGTGATTTCAGGGAAGACTGGCAGACATGGG ATTGTCCAAAGACCCAGGAGCATATAGAAGAAAG CAGAACTGGATGGGCTGGTGGATTCTTTGTTTCAA CACCAGTTTTCAGCTATGATGCCATTTCATACTACA AAATATTTAGTGACAAGGATGGCTACAAACATATT CACTATATCAAAGACACTGTGGAAAATGCTATTCA AATTACAAGTGGCAAGTGGGAGGCCATAAATATA TTCAGAGTAACACAGGATTCACTGTTTTATTCTAG CAATGAATTTGAAGATTACCCTGGAAGAAGAAAC ATCTACAGAATTAGCATTGGAAGCTATCCTCCAAG CAAGAAGTGTGTTACTTGCCATCTAAGGAAAGAAA GGTGCCAATATTACACAGCAAGTTTCAGCGACTAC GCCAAGTACTATGCACTTGTCTGCTATGGCCCAGG CATCCCCATTTCCACCCTTCATGACGGACGCACTG ATCAAGAAATTAAAATCCTGGAAGAAAACAAGGA ATTGGAAAATGCTTTGAAAAATATCCAGCTGCCTA AAGAGGAAATTAAGAAACTTGAAGTAGATGAAAT TACTTTATGGTACAAGATGATTCTTCCTCCTCAATT TGACAGATCAAAGAAGTATCCCTTGCTAATTCAAG TGTATGGTGGTCCCTGCAGTCAGAGTGTAAGGTCT GTATTTGCTGTTAATTGGATATCTTATCTTGCAAGT AAGGAAGGGATGGTCATTGCCTTGGTGGATGGTCG GGGAACAGCTTTCCAAGGTGACAAACTCCTGTATG CAGTGTATCGAAAGCTGGGTGTTTATGAAGTTGAA GACCAGATTACAGCTGTCAGAAAATTCATAGAAAT GGGTTTCATTGATGAAAAAAGAATAGCCATATGGG GCTGGTCCTATGGAGGATATGTTTCATCACTGGCC CTTGCATCTGGAACTGGTCTTTTCAAATGTGGGAT AGCAGTGGCTCCAGTCTCCAGCTGGGAATATTACG CGTCTGTCTACACAGAGAGATTCATGGGTCTCCCA ACAAAGGATGATAATCTTGAGCACTATAAGAATTC AACTGTGATGGCAAGAGCAGAATATTTCAGAAAT GTAGACTATCTTCTCATCCACGGAACAGCAGATGA TAATGTGCACTTTCAAAACTCAGCACAGATTGCTA AAGCTCTGGTTAATGCACAAGTGGATTTCCAGGCA ATGTGGTACTCTGACCAGAACCACGGCTTATCCGG CCTGTCCACGAACCACTTATACACCCACATGACCC ACTTCCTAAAGCAGTGTTTCTCTTTGTCAGACGGC AAAAAGAAAAAGAAAAGGGCCACCACCATCACC ATCAC |

TABLE C-continued (Sequences):

| SEQ ID NO: | Name | Sequence |
|---|---|---|
| 28 | human CEA | UniProt no. P06731 |
| 29 | human MCSP | UniProt no. Q6UVK1 |
| 30 | human EGFR | UniProt no. P00533 |
| 31 | human CD19 | UniProt no. P15391 |
| 32 | human CD20 | Uniprot no. P11836 |
| 33 | human CD33 | UniProt no. P20138 |
| 34 | human Lymphotoxin α | UniProt no. P01374 |
| 35 | human TNF | UniProt no. P01375 |
| 36 | human Lymphotoxin β | UniProt no. Q06643 |
| 37 | human OX40L | UniProt no. P23510 |
| 38 | human CD40L | UniProt no. P29965 |
| 39 | human FasL | UniProt no. P48023 |
| 40 | human CD27L | UniProt no. P32970 |
| 41 | human CD30L | UniProt no. P32971 |
| 42 | human 4-1BBL | UniProt no. P41273 |
| 43 | human TRAIL | UniProt no. P50591 |
| 44 | human RANKL | UniProt no. O14788 |
| 45 | human TWEAK | UniProt no. O43508 |
| 46 | human APRIL | UniProt no. O75888 |
| 47 | human BAFF | UniProt no. Q9Y275 |
| 48 | human LIGHT | UniProt no. O43557 |
| 49 | human TL1A | UniProt no. O95150 |
| 50 | human GITRL | UniProt no. Q9UNG2 |
| 51 | human ectodysplasin A | UniProt no. Q92838 |
| 52 | hu 4-1BBL (50-254) | ACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE |
| 53 | hu OX40L (51-183) | QVSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL |
| 54 | hu OX40L (52-183) | VSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL |
| 55 | Peptide linker (SG4)$_2$ | SGGGGSGGGG |
| 56 | Peptide linker G4(SG4)$_2$ | GGGGSGGGGSGGGG |
| 57 | Peptide linker | GSPGSSSSGS |
| 58 | Peptide linker (G4S)$_4$ | GGGGSGGGGSGGGGSGGGGS |
| 59 | Peptide linker | GSGSGNGS |

TABLE C-continued (Sequences):

| SEQ ID NO: | Name | Sequence |
|---|---|---|
| 60 | Peptide linker | GGSGSGSG |
| 61 | Peptide linker | GGSGSG |
| 62 | Peptide linker | GGSG |
| 63 | Peptide linker | GGSGNGSG |
| 64 | Peptide linker | GGNGSGSG |
| 65 | Peptide linker | GGNGSG |
| 66 | nucleotide sequence dimeric hu 4-1BBL (71-254)-CH1 Fc knob chain | See Table 2 |
| 67 | nucleotide sequence monomeric hu 4-1BBL (71-254)-CL1 | See Table 2 |
| 68 | nucleotide sequence anti-FAP(28H1) Fc hole chain | See Table 2 |
| 69 | nucleotide sequence anti-FAP (28H1) light chain | See Table 2 |
| 70 | Murine (mu) 4-1BBL | UniProt no. Q3U1Z9-1 |
| 71 | nucleotide sequence dimeric mu 4-1BBL (104-309, C137, 160, 246S)- CH1 Fc knob chain | See Table 13 |
| 72 | nucleotide sequence monomeric mu 4-1BBL (104-309, C137, 160, 246S)-CL | See Table 13 |
| 73 | nucleotide sequence anti-FAP Fc KK chain | See Table 13 |
| 74 | nucleotide sequence anti-FAP light chain | See Table 13 |
| 75 | dimeric mu 4-1BBL (104-309, C137, 160, 246S)- CL Fc DD chain | See Table 13 |
| 76 | monomeric mu 4-1BBL (104-309, C137, 160, 246S)-CL1 | See Table 13 |
| 77 | anti-FAP Fc KK chain | See Table 13 |
| 78 | anti-FAP light chain | See Table 13 |
| 79 | nucleotide sequence DP47 Fc-hole chain | See Table 18 |
| 80 | nucleotide sequence DP47 light chain | See Table 18 |
| 81 | DP47 Fc-hole chain | See Table 18 |
| 82 | DP47 light chain | See Table 18 |
| 83 | Human 4-1BB Fc(kih) | See Table 31 |
| 84 | Cynomolgus 4-1BB Fc(kih) | See Table 31 |
| 85 | Murine 4-1BB Fc(kih) | See Table 31 |

TABLE C-continued (Sequences):

| SEQ ID NO: | Name | Sequence |
|---|---|---|
| 86 | nucleotide sequence Fc hole chain | See Table 32 |
| 87 | nucleotide sequence Human 4-1BB Fc(kih) | See Table 32 |
| 88 | nucleotide sequence Cynomolgus 4-1BB Fc(kih) | See Table 32 |
| 89 | nucleotide sequence Murine 4-1BB Fc(kih) | See Table 32 |
| 90 | Fc hole chain | See Table 32 |
| 91 | Human 4-1BB Fc(kih) | See Table 32 |
| 92 | Cynomolgus 4-1BB Fc(kih) | See Table 32 |
| 93 | Murine 4-1BB Fc(kih) | See Table 32 |
| 94 | nucleotide sequence Human 4-1BB His | See Table 33 |
| 95 | Human 4-1BB His | See Table 33 |
| 96 | Human (hu) 4-1BBL (71-248) | REGPELSPDDPAGLLDLRQGMFAQLVAQNVLLIDGP LSWYSDPGLAGVSLTGGLSYKEDTKELVVAKAGVY YVFFQLELRRVVAGEGSGSVSLALHLQPLRSAAGAA ALALTVDLPPASSEARNSAFGFQGRLLHLSAGQRLG VHLHTEARARHAWQLTQGATVLGLFRVTPEIPAGL |
| 97 | dimeric hu 4-1BBL (71-248) connected by (G₄S)₂ linker | REGPELSPDDPAGLLDLRQGMFAQLVAQNVLLIDGP LSWYSDPGLAGVSLTGGLSYKEDTKELVVAKAGVY YVFFQLELRRVVAGEGSGSVSLALHLQPLRSAAGAA ALALTVDLPPASSEARNSAFGFQGRLLHLSAGQRLG VHLHTEARARHAWQLTQGATVLGLFRVTPEIPAGLG GGGSGGGGSREGPELSPDDPAGLLDLRQGMFAQLVA QNVLLIDGPLSWYSDPGLAGVSLTGGLSYKEDTKEL VVAKAGVYYVFFQLELRRVVAGEGSGSVSLALHLQP LRSAAGAAALALTVDLPPASSEARNSAFGFQGRLLH LSAGQRLGVHLHTEARARHAWQLTQGATVLGLFRV TPEIPAGL |
| 98 | dimeric hu 4-1BBL (80-254) connected by (G₄S)₂ linker | DPAGLLDLRQGMFAQLVAQNVLLIDGPLSWYSDPGL AGVSLTGGLSYKEDTKELVVAKAGVYYVFFQLELRR VVAGEGSGSVSLALHLQPLRSAAGAAALALTVDLPP ASSEARNSAFGFQGRLLHLSAGQRLGVHLHTEARAR HAWQLTQGATVLGLFRVTPEIPAGLPSPRSEGGGGSG GGGSDPAGLLDLRQGMFAQLVAQNVLLIDGPLSWY SDPGLAGVSLTGGLSYKEDTKELVVAKAGVYYVFFQ LELRRVVAGEGSGSVSLALHLQPLRSAAGAAALALT VDLPPASSEARNSAFGFQGRLLHLSAGQRLGVHLHT EARARHAWQLTQGATVLGLFRVTPEIPAGLPSPRSE |
| 99 | dimeric hu 4-1BBL (52-254) connected by (G₄S)₂ linker | PWAVSGARASPGSAASPRLREGPELSPDDPAGLLDLR QGMFAQLVAQNVLLIDGPLSWYSDPGLAGVSLTGGL SYKEDTKELVVAKAGVYYVFFQLELRRVVAGEGSG SVSLALHLQPLRSAAGAAALALTVDLPPASSEARNSA FGFQGRLLHLSAGQRLGVHLHTEARARHAWQLTQG ATVLGLFRVTPEIPAGLPSPRSEGGGGSGGGGSPWAV SGARASPGSAASPRLREGPELSPDDPAGLLDLRQGMF AQLVAQNVLLIDGPLSWYSDPGLAGVSLTGGLSYKE DTKELVVAKAGVYYVFFQLELRRVVAGEGSGSVSL ALHLQPLRSAAGAAALALTVDLPPASSEARNSAFGF QGRLLHLSAGQRLGVHLHTEARARHAWQLTQGATV LGLFRVTPEIPAGLPSPRSE |
| 100 | FAP(4B9) CDR-H1 | SYAMS |
| 101 | FAP(4B9) CDR-H2 | AIIGSGASTYYADSVKG |
| 102 | FAP(4B9) CDR-H3 | GWFGGFNY |
| 103 | FAP(4B9) CDR-L1 | RASQSVTSSYLA |

TABLE C-continued (Sequences):

| SEQ ID NO: | Name | Sequence |
|---|---|---|
| 104 | FAP(4B9) CDR-L2 | VGSRRAT |
| 105 | FAP(4B9) CDR-L3 | QQGIMLPPT |
| 106 | FAP(4B9) VH | EVQLLESGGGLVQPGGSLRLSCAASGFTFSSYA MSWVRQAPGKGLEWVSAIIGSGASTYYADSVK GRFTISRDNSKNTLYLQMNSLRAEDTAVYYCAK GWFGGFNYWGQGTLVTVSS |
| 107 | FAP(4B9) VL | EIVLTQSPGTLSLSPGERATLSCRASQSVTSSYLA WYQQKPGQAPRLLINVGSRRATGIPDRFSGSGSG TDFTLTISRLEPEDFAVYYCQQGIMLPPTFGQGT KVEIK |
| 108 | dimeric hu 4-1BBL (71-254)-CH1* Fc knob chain | see Table 4 |
| 109 | monomeric hu 4-1BBL (71-254)-CL* | see Table 4 |
| 110 | monomeric hu 4-1BBL (71-254)-(G4S)1-CL* | see Table 7 |
| 111 | dimeric hu 4-1BBL (52-254)-CH1* Fc knob chain | see Table 10 |
| 112 | monomeric hu 4-1BBL (52-254)-CL* | see Table 10 |
| 113 | dimeric hu 4-1BBL (80-254)-CH1* Fc knob chain | see Table 11 |
| 114 | monomeric hu 4-1BBL (80-254)-CL* | see Table 11 |
| 115 | dimeric hu 4-1BBL (71-254)-CL* Fc knob chain | see Table 3 |
| 116 | monomeric hu 4-1BBL (71-254)-CH1* | see Table 3 |
| 117 | dimeric hu 4-1BBL (71-254)-CL Fc knob chain | see Table 22 |
| 118 | monomeric hu 4-1BBL (71-254)-CH1 | see Table 22 |
| 119 | dimeric hu 4-1BBL (71-248)-CL* Fc knob chain | see Table 24 |
| 120 | monomeric hu 4-1BBL (71-248)-CH1* | see Table 24 |
| 121 | anti-FAP (28H1) Fc hole chain fused to dimeric 4-1BBL (71-254) | see Table 6 |
| 122 | anti-FAP (28H1) Fc knob chain fused to monomeric 4-1BBL (71-254) | see Table 6 |
| 123 | anti-FAP (4B9) Fc hole chain fused to dimeric 4-1BBL (71-254) | see Table 23 |
| 124 | anti-FAP (4B9) Fc knob chain fused to monomeric 4-1BBL (71-254) | see Table 23 |
| 125 | anti-FAP (4B9) light chain | see Table 21 |
| 126 | anti-FAP (4B9) Fc hole chain fused to dimeric 4-1BBL (71-248) | see Table 26 |

TABLE C-continued (Sequences):

| SEQ ID NO: | Name | Sequence |
|---|---|---|
| 127 | anti-FAP (4B9) Fc knob chain fused to monomeric 4-1BBL (71-248) | see Table 26 |
| 128 | Peptide linker | GGGGS |
| 129 | nucleotide sequence dimeric hu 4-1BBL (71-254)- CL* Fc knob chain | see Table 3 |
| 130 | nucleotide sequence monomeric hu 4-1BBL (71-254)- CH1* | see Table 3 |
| 131 | nucleotide sequence dimeric hu 4-1BBL (71-254)- CH1* Fc knob chain | see Table 4 |
| 132 | nucleotide sequence monomeric hu 4-1BBL (71-254)- CL* | see Table 4 |
| 133 | nucleotide sequence anti-FAP (28H1) (VHCL) Fc hole chain | see Table 4 |
| 134 | nucleotide sequence anti-FAP (28H1) (VLCH1) light chain | see Table 4 |
| 135 | anti-FAP (VHCL) (28H1) Fc hole chain | see Table 4 |
| 136 | anti-FAP (VLCH1) (28H1) light chain | see Table 4 |
| 137 | nucleotide sequence monomeric hu 4-1BBL (71-254)- CH1* Fc knob chain | see Table 5 |
| 138 | nucleotide sequence dimeric hu 4-1BBL (71-254)- CL* | see Table 5 |
| 139 | monomeric hu 4-1BBL (71-254)- CL* Fc knob chain | see Table 5 |
| 140 | dimeric hu 4-1BBL (71-254)- CL* | see Table 5 |
| 141 | nucleotide sequence anti-FAP (28H1) Fc hole chain fused to dimeric hu 4-1BBL (71-254) | see Table 6 |
| 142 | nucleotide sequence anti-FAP (28H1) Fc knob chain fused to monomeric hu 4-1BBL (71-254) | see Table 6 |
| 143 | nucleotide sequence monomeric hu 4-1BBL (71-254)- (G4S)$_1$-CL* | see Table 7 |
| 144 | nucleotide sequence [anti-FAP (28H1)]$_2$ Fc hole chain | see Table 8 |
| 145 | [anti-FAP (28H1)]$_2$ Fc hole chain | see Table 8 |
| 146 | nucleotide sequence dimeric hu 4-1BBL (71-254)- FAP (VHCL*) Fc knob chain | see Table 9 |

TABLE C-continued (Sequences):

| SEQ ID NO: | Name | Sequence |
|---|---|---|
| 147 | nucleotide sequence monomeric hu 4-1BBL (71-254)-FAP (VLCH1*) | see Table 9 |
| 148 | dimeric hu 4-1BBL (71-254)-FAP (VHCL*) Fc knob chain | see Table 9 |
| 149 | monomeric hu 4-1BBL (71-254)-FAP (VLCH1*) | see Table 9 |
| 150 | nucleotide sequence dimeric hu 4-1BBL (52-254)-CH1* Fc knob chain | see Table 10 |
| 151 | nucleotide sequence Monomeric hu 4-1BBL (52-254)-CL* | see Table 10 |
| 152 | nucleotide sequence dimeric hu 4-1BBL (80-254)-CH1* Fc knob chain | see Table 11 |
| 153 | nucleotide sequence Monomeric hu 4-1BBL (80-254)-CL* | see Table 11 |
| 154 | nucleotide sequence DP47 FC KK chain | see Table 14 |
| 155 | nucleotide sequence DP47 light chain | see Table 14 |
| 156 | DP47 FC KK chain | see Table 14 |
| 157 | DP47 light chain | see Table 14 |
| 158 | nucleotide sequence dimeric mu 4-1BBL (104-309, C160S)- CL Fc DD chain | see Table 15 |
| 159 | nucleotide sequence monomeric murine 4-1BBL (104-309, C160S)- CH1 | see Table 15 |
| 160 | dimeric mu 4-1BBL (104-309, C160S)- CL Fc DD chain | see Table 15 |
| 161 | monomeric murine 4-1BBL (104-309, C160S)- CH1 | see Table 15 |
| 162 | nucleotide sequence anti-FAP (4B9) Fc hole chain | see Table 21 |
| 163 | nucleotide sequence anti-FAP (4B9) light chain | see Table 21 |
| 164 | anti-FAP (4B9) Fc hole chain | see Table 21 |
| 165 | nucleotide sequence dimeric hu 4-1BBL (71-254)- CL Fc knob chain | see Table 22 |
| 166 | nucleotide sequence monomeric hu 4-1BBL (71-254)- CH1 | see Table 22 |
| 167 | nucleotide sequence anti-FAP (4B9) Fc hole chain fused to dimeric hu 4-1BBL (71-254) | see Table 23 |

TABLE C-continued (Sequences):

| SEQ ID NO: | Name | Sequence |
|---|---|---|
| 168 | nucleotide sequence anti-FAP (4B9) Fc knob chain fused to monomeric hu 4-1BBL (71-254) | see Table 23 |
| 169 | nucleotide sequence dimeric hu 4-1BBL (71-248)- CL* Fc knob chain | see Table 24 |
| 170 | nucleotide sequence monomeric hu 4-1BBL (71-248)- CH1* | see Table 24 |
| 171 | nucleotide sequence dimeric hu 4-1BBL (71-248)- CL Fc knob chain | see Table 25 |
| 172 | nucleotide sequence monomeric hu 4-1BBL (71-248)- CH1 | see Table 25 |
| 173 | Dimeric hu 4-1BBL (71-248)- CL Fc knob chain | see Table 25 |
| 174 | Monomeric hu 4-1BBL (71-248)- CH1 | see Table 25 |
| 175 | nucleotide sequence anti-FAP (4B9) Fc hole chain fused to dimeric hu 4-1BBL (71-248) | see Table 26 |
| 176 | nucleotide sequence anti-FAP (4B9) Fc knob chain fused to monomeric hu 4-1BBL (71-248) | see Table 26 |
| 177 | nucleotide sequence DP47 Fc hole chain fused to dimeric hu 4-1BBL (71-254) | see Table 27 |
| 178 | nucleotide sequence DP47 Fc knob chain fused to monomeric hu 4-1BBL (71-254) | see Table 27 |
| 179 | DP47 Fc hole chain fused to dimeric hu 4-1BBL (71-254) | see Table 27 |
| 180 | DP47 Fc knob chain fused to monomeric hu 4-1BBL (71-254) | see Table 27 |
| 181 | nucleotide sequence DP47 heavy chain (hu IgG1 PGLALA) | see Table 29 |
| 182 | DP47 heavy chain (hu IgG1 PGLALA) | see Table 29 |
| 183 | monomeric hu 4-1BBL (71-254) plus (G4S)$_1$ linker | REGPELSPDDPAGLLDLRQGMFAQLVAQNVLLIDGP LSWYSDPGLAGVSLTGGLSYKEDTKELVVAKAGVY YVFFQLELRRVVAGEGSGSVSLAHLQPLRSAAGAA ALALTVDLPPASSEARNSAFGFQGRLLHLSAGQRLG VHLHTEARARHAWQLTQGATVLGLFRVTPEIPAGLP SPRSEGGGGS |
| 184 | monomeric hu 4-1BBL (71-248) plus (G4S)$_2$ linker | REGPELSPDDPAGLLDLRQGMFAQLVAQNVLLIDGP LSWYSDPGLAGVSLTGGLSYKEDTKELVVAKAGVY YVFFQLELRRVVAGEGSGSVSLAHLQPLRSAAGAA ALALTVDLPPASSEARNSAFGFQGRLLHLSAGQRLG VHLHTEARARHAWQLTQGATVLGLFRVTPEIPAGLG GGSGGGGS |

…

TABLE C-continued (Sequences):

| SEQ ID NO: | Name | Sequence |
|---|---|---|
| 185 | monomeric hu 4-1BBL (71-248) plus (G4S)1 linker | REGPELSPDDPAGLLDLRQGMFAQLVAQNVLLIDGP LSWYSDPGLAGVSLTGGLSYKEDTKELVVAKAGVY YVFFQLELRRVVAGEGSGSVSLALHLQPLRSAAGAA ALALTVDLPPASSEARNSAFGFQGRLLHLSAGQRLG VHLHTEARARHAWQLTQGATVLGLFRVTPEIPAGLG GGGS |
| 186 | Nucleotide sequence human CD19 antigen Fc knob chain avi tag | see Table 43 |
| 187 | Polypeptide sequence human CD19 antigen Fc knob chain avi tag | see Table 43 |
| 188 | Nucleotide sequence cynomolgus CD19 antigen Fc knob chain avi tag | see Table 43 |
| 189 | Polypeptide sequence cynomolgus CD19 antigen Fc knob chain avi tag | see Table 43 |
| 190 | humanized CD19 (8B8) HVR-L1 | NSNGNT |
| 191 | humanized CD19 (8B8) HVR-H2 | KFNG |
| 192 | humanized CD19 (8B8) var.1 to 9 HVR-H2 | TEKFQGRVTM |
| 193 | humanized CD19 (8B8) var.5 HVR-L1 | LENPNGNT |
| 194 | humanized CD19 (8B8) var.9 HVR-L1 | LENPSGNT |
| 195 | CD19 (8B8-018) CDR-H1 | DYIMH |
| 196 | CD19 (8B8-018) CDR-H2 | YINPYNDGSKYTEKFQG |
| 197 | CD19 (8B8-018) CDR-H3 | GTYYYGSALFDY |
| 198 | CD19 (8B8-018) CDR-L1 | KSSQSLENPNGNTYLN |
| 199 | CD19 (8B8-018) CDR-L2 | RVSKRFS |
| 200 | CD19 (8B8-018) CDR-L3 | LQLTHVPYT |
| 201 | CD19 (8B8-018) VH | QVQLVQSGAEVKKPGASVKVSCKASGYTFTDYIMH WVRQAPGQGLEWMGYINPYNDGSKYTEKFQGRVT MTSDTSISTAYMELSRLRSDDTAVYYCARGTYYYGS ALFDYWGQGTTVTVSS |
| 202 | CD19 (8B8-018) VL | DIVMTQTPLSLSVTPGQPASISCKSSQSLENPNGNTYL NWYLQKPGQSPQLLIYRVSKRFSGVPDRFSGSGSGTD FTLKISRVEAEDVGVYYCLQLTHVPYTFGQGTKLEIK |
| 203 | Nucleotide sequence anti-CD19(8B8-018) Fc hole chain | see Table 47 |
| 204 | Nucleotide sequence anti-CD19(8B8-018) light chain | see Table 47 |
| 205 | anti-CD19(8B8-018) Fc hole chain | see Table 47 |
| 206 | anti-CD19(8B8-018) light chain | see Table 47 |

TABLE C-continued (Sequences):

| SEQ ID NO: | Name | Sequence |
|---|---|---|
| 207 | Nucleotide sequence anti-CD19(8B8-018) Fc hole dimeric ligand chain | see Table 49 |
| 208 | Nucleotide sequence anti-CD19(8B8-018) Fc knob monomeric ligand | see Table 49 |
| 209 | anti-CD19(8B8-018) Fc hole dimeric ligand chain | see Table 49 |
| 210 | anti-CD19(8B8-018) Fc knob monomeric ligand | see Table 49 |
| 211 | Nucleotide sequence anti-CD19(8B8-018) Fc hole dimeric ligand (71-248) chain | see Table 52 |
| 212 | Nucleotide sequence anti-CD19(8B8-018) Fc knob monomeric (71-248) ligand | see Table 52 |
| 213 | anti-CD19(8B8-018) Fc hole dimeric ligand (71-248) chain | see Table 52 |
| 214 | anti-CD19(8B8-018) Fc knob monomeric (71-248) ligand | see Table 52 |
| 215 | Nucleotide sequence CD19 (8B8) VH Parental clone | GAGGTCCAGCTGCAGCAGTCTGGACCTGAGCTGGT AAAGCCTGGGGCTTCAGTGAAGATGGCCTGCAAG GCTTCTGGATACACATTCACTGACTATATTATGCA CTGGGTGAAGCAGAAGACTGGGCAGGGCCTTGAG TGGATTGGATATATTAATCCTTACAATGATGGTTCT AAGTACACTGAGAAGTTCAACGGCAAGGCCACAC TGACTTCAGACAAATCTTCCATCACAGCCTACATG GAGCTCAGCAGCCTGACCTCTGAGGACTCTGCGGT CTATTACTGTGCAAGAGGGACCTATTATTATGGTA GCGCCCTCTTTGACTACTGGGGCCAAGGCACCACT CTCACAGTCTCCTCG |
| 216 | Nucleotide sequence CD19 (8B8) VL Parental clone | GATGCTGTGATGACCCAAACTCCACTCTCCCTGCC TGTCAGTCTTGGAGATCAAGCCTCCATCTCTTGCA GGTCTAGTCAGAGCCTTGAAAACAGTAATGGAAA CACCTATTTGAACTGGTACCTCCAGAAACCAGGCC AGTCTCCACAACTCCTGATCTACAGGGTTTCCAAA CGATTTTCTGGGGTCCTAGACAGGTTCAGTGGTAG TGGATCAGGGACAGATTTCACACTGAAAATCAGCA GAGTGGAGGCTGAGGATTTGGGAGTTTATTTCTGC CTACAACTTACACATGTCCCGTACACGTTCGGAGG GGGGACCAAGCTGGAAATAAAA |
| 217 | CD19 L1 reverse random | see Table 53 |
| 218 | CD19 L2 forward random | see Table 53 |
| 219 | CD19 H1 reverse random | see Table 53 |
| 220 | CD19 H2 forward random | see Table 53 |
| 221 | CD19 H3 reverse constant | see Table 53 |
| 222 | LMB3 | see Table 53 |
| 223 | D19 L1 forward constant | see Table 54 |
| 224 | CD19 L3 reverse random | see Table 54 |
| 225 | CD19 L3 forward constant | see Table 54 |
| 226 | CD19 H3 reverse random | see Table 54 |

TABLE C-continued (Sequences):

| SEQ ID NO: | Name | Sequence |
|---|---|---|
| 227 | Nucleotide sequence SNAP tag human CD19 ECD-PDGFR | GGCCGCCGCTAGCGGCATCGACTACAAGGACGAC GATGACAAGGCCGGCATCGATGCCATCATGGACA AAGACTGCGAAATGAAGCGCACCACCCTGGATAG CCCTCTGGGCAAGCTGGAACTGTCTGGGTGCGAAC AGGGCCTGCACGAGATCAAGCTGCTGGGCAAAGG AACATCTGCCGCCGACGCCGTGGAAGTGCCTGCCC CAGCCGCCGTGCTGGGCGGACCAGAGCCACTGAT GCAGGCCACCGCCTGGCTCAACGCCTACTTTCACC AGCCTGAGGCCATCGAGGAGTTCCCTGTGCCAGCC CTGCACCACCCAGTGTTCCAGCAGGAGAGCTTTAC CCGCCAGGTGCTGTGGAAACTGCTGAAAGTGGTGA AGTTCGGAGAGGTCATCAGCTACCAGCAGCTGGCC GCCCTGGCCGGCAATCCCGCCGCCACCGCCGCCGT GAAAACCGCCCTGAGCGGAAATCCCGTGCCCATTC TGATCCCCTGCCACCGGGTGGTGTCTAGCTCTGGC GCCGTGGGGGGCTACGAGGGCGGGCTCGCCGTGA AGAGTGGCTGCTGGCCCACGAGGGCCACAGACT GGGCAAGCCTGGGCTGGGTGATATCCCCGAGGAA CCCCTGGTCGTGAAGGTGGAAGAGGGCGACAATG CCGTGCTGCAGTGCCTGAAGGGCACCTCCGATGGC CCTACCCAGCAGCTGACCTGGTCCAGAGAGAGCCC CCTGAAGCCCTTCCTGAAGCTGTCTCTGGGCCTGC CTGGCCTGGGCATCCATATGAGGCCTCTGGCCATC TGGCTGTTCATCTTCAACGTGTCCCAGCAGATGGG CGGCTTCTACCTGTGTCAGCCTGGCCCCCCATCTG AGAAGGCTTGGCAGCCTGGCTGGACCGTGAACGT GGAAGGATCCGGCGAGCTGTTCCGGTGGAACGTGT CCGATCTGGGCGGCCTGGGATGCGGCCTGAAGAA CAGATCTAGCGAGGGCCCCAGCAGCCCCAGCGGC AAACTGATGAGCCCCAAGCTGTACGTGTGGGCCAA GGACAGACCCGAGATCTGGGAGGGCGAGCCTCCT TGCCTGCCCCCTAGAGACAGCCTGAACCAGAGCCT GAGCCAGGACCTGACAATGGCCCCTGGCAGCACA CTGTGGCTGAGCTGTGGCGTGCCACCCGACTCTGT GTCTAGAGGCCCTCTGAGCTGGACCCACGTGCACC CTAAGGGCCCTAAGAGCCTGCTGAGCCTGGAACTG AAGGACGACAGGCCCGCCAGAGATATGTGGGTCA TGGAAACCGGCCTGCTGCTGCCTAGAGCCACAGCC CAGGATGCCGGCAAGTACTACTGCCACAGAGGCA ACCTGACCATGAGCTTCCACCTGGAAATCACCGCC AGACCCGTGCTGTGGCACTGGCTGCTGAGAACAGG CGGCTGGAAGGTCGACGAACAAAAACTCATCTCA GAAGAGGATCTGAATGCTGTGGGCCAGGACACGC AGGAGGTCATCGTGGTGCCACACTCCTTGCCCTTT AAGGTGGTGGTGATCTCAGCCATCCTGGCCCTGGT GGTGCTCACCATCATCTCCCTTATCATCCTCATCAT GCTTTGGCAGAAGAAGCCACGT |
| 228 | Nucleotide sequence SNAP tag cynomolgus CD19 ECD-PDGFR | CCGGCCGCCGCTAGCGGCATCGACTACAAGGACG ACGATGACAAGGCCGGCATCGATGCCATCATGGA CAAAGACTGCGAAATGAAGCGCACCACCCTGGAT AGCCCTCTGGGCAAGCTGGAACTGTCTGGGTGCGA ACAGGGCCTGCACGAGATCAAGCTGCTGGGCAAA GGAACATCTGCCGCCGACGCCGTGGAAGTGCCTGC CCCAGCCGCCGTGCTGGGCGGACCAGAGCCACTG ATGCAGGCCACCGCCTGGCTCAACGCCTACTTTCA CCAGCCTGAGGCCATCGAGGAGTTCCCTGTGCCAG CCCTGCACCACCCAGTGTTCCAGCAGGAGAGCTTT ACCCGCCAGGTGCTGTGGAAACTGCTGAAAGTGGT GAAGTTCGGAGAGGTCATCAGCTACCAGCAGCTG GCCGCCCTGGCCGGCAATCCCGCCGCCACCGCCGC CGTGAAAACCGCCCTGAGCGGAAATCCCGTGCCCA TTCTGATCCCCTGCCACCGGGTGGTGTCTAGCTCTG GCGCCGTGGGGGGCTACGAGGGCGGGCTCGCCGT GAAAGAGTGGCTGCTGGCCCACGAGGGCCACAGA CTGGGCAAGCCTGGGCTGGGTGATATCCCCCAGGA ACCCCTGGTCGTGAAGGTGGAAGAGGGCGACAAT GCCGTGCTCCAGTGTCTCGAGGGCACCTCCGATGG CCCTACACAGCAGCTCGTGTGGTGCAGAGACAGCC CCTTCGAGCCCTTCCTGAACCTGTCTCTGGGCCTGC CTGGCATGGGCATCAGAATGGGCCCTCTGGGCATC TGGCTGCTGATCTTCAACGTGTCCAACCAGACCGG CGGCTTCTACCTGTGTCAGCCTGGCCTGCCAAGCG AGAAGGCTTGGCAGCCTGGATGGACCGTGTCCGTG GAAGGATCTGGCGAGCTGTTCCGGTGGAACGTGTC |

TABLE C-continued (Sequences):

| SEQ ID NO: | Name | Sequence |
|---|---|---|
| | | CGATCTGGGCGGCCTGGGATGCGGCCTGAAGAAC<br>AGAAGCAGCGAGGGCCCTAGCAGCCCCAGCGGCA<br>AGCTGAATAGCAGCCAGCTGTACGTGTGGGCCAA<br>GGACAGACCCGAGATGTGGGAGGGCGAGCCTGTG<br>TGTGGCCCCCCTAGAGATAGCCTGAACCAGAGCCT<br>GAGCCAGGACCTGACAATGGCCCCTGGCAGCACA<br>CTGTGGCTGAGCTGTGGCGTGCCACCCGACTCTGT<br>GTCCAGAGGCCCTCTGAGCTGGACACACGTGCGGC<br>CTAAGGGCCCCAAGAGCAGCCTGCTGAGCCTGGA<br>ACTGAAGGACGACCGGCCCGACCGGGATATGTGG<br>GTGGTGGATACAGGCCTGCTGCTGACCAGAGCCAC<br>AGCCCAGGATGCCGGCAAGTACTACTGCCACAGA<br>GGCAACTGGACCAAGAGCTTTTACCTGGAAATCAC<br>CGCCAGACCCGCCCTGTGGCACTGCTGCTGAGAA<br>TCGGAGGCTGGAAGGTCGACGAGCAGAAGCTGAT<br>CTCCGAAGAGGACCTGAACGCCGTGGGCCAGGAT<br>ACCCAGGAAGTGATCGTGGTGCCCCACAGCCTGCC<br>CTTCAAGGTGGTCGTGATCAGCGCCATTCTGGCCC<br>TGGTGGTGCTGACCATCATCAGCCTGATCATCCTG<br>ATTATGCTGTGGCAGAAAAAGCCCCGC |
| 229 | Polypeptide sequence SNAP tag human CD19 ECD-PDGFR | PAAASGIDYKDDDDKAGIDAIMDKDCEMKRTTLDSP<br>LGKLELSGCEQGLHEIKLLGKGTSAADAVEVPAPAA<br>VLGGPEPLMQATAWLNAYFHQPEAIEEFPVPALHHP<br>VFQQESFTRQVLWKLLKVVKFGEVISYQQLAALAGN<br>PAATAAVKTALSGNPVPILIPCHRVVSSSGAVGGYEG<br>GLAVKEWLLAHEGHRLGKPGLGDIPEEPLVVKVEEG<br>DNAVLQCLKGTSDGPTQQLTWSRESPLKPFLKLSLG<br>LPGLGIHMRPLAIWLFIFNVSQQMGGFYLCQPGPPSE<br>KAWQPGWTVNVEGSGELFRWNVSDLGGLGCGLKN<br>RSSEGPSSPSGKLMSPKLYVWAKDRPEIWEGEPPCLP<br>PRDSLNQSLSQDLTMAPGSTLWLSCGVPPDSVSRGPL<br>SWTHVHPKGPKSLLSLELKDDRPARDMWVMETGLL<br>LPRATAQDAGKYYCHRGNLTMSFHLEITARPVLWH<br>WLLRTGGWKVDEQKLISEEDLNAVGQDTQEVIVVP<br>HSLPFKVVVISAILALVVLTIISLIILIMLWQKKPR |
| 230 | Polypeptide sequence SNAP tag cynomolgus CD19 ECD-PDGFR | PAAASGIDYKDDDDKAGIDAIMDKDCEMKRTTLDSP<br>LGKLELSGCEQGLHEIKLLGKGTSAADAVEVPAPAA<br>VLGGPEPLMQATAWLNAYFHQPEAIEEFPVPALHHP<br>VFQQESFTRQVLWKLLKVVKFGEVISYQQLAALAGN<br>PAATAAVKTALSGNPVPILIPCHRVVSSSGAVGGYEG<br>GLAVKEWLLAHEGHRLGKPGLGDIPQEPLVVKVEEG<br>DNAVLQCLEGTSDGPTQQLVWCRDSPFEPFLNLSLG<br>LPGMGIRMGPLGIWLLIFNVSNQTGGFYLCQPGLPSE<br>KAWQPGWTVSVEGSGELFRWNVSDLGGLGCGLKN<br>RSSEGPSSPSGKLNSSQLYVWAKDRPEMWEGEPVCG<br>PPRDSLNQSLSQDLTMAPGSTLWLSCGVPPDSVSRGP<br>LSWTHVRPKGPKSSLLSLELKDDRPDRDMWVVDTG<br>LLLTRATAQDAGKYYCHRGNWTKSFYLEITARPAL<br>WHWLLRIGGWKVDEQKLISEEDLNAVGQDTQEVIV<br>VPHSLPFKVVVISAILALVVLTIISLIILIMLWQKKPR |
| 231 | CD19 (8B8-5H09) CDR-L1 | see Table 56 |
| 232 | CD19 (8B8-5H09) CDR-L2 | see Table 56 |
| 233 | CD19 (8B8-5H09) CDR-L3 | see Table 56 |
| 234 | CD19 (8B8-5H09) CDR-H1 | see Table 57 |
| 235 | CD19 (8B8-5H09) CDR-H2 | see Table 57 |
| 236 | CD19 (8B8-5H09) CDR-H3 | see Table 57 |
| 237 | CD19 (8B8-7H07) CDR-L1 | see Table 56 |
| 238 | CD19 (8B8-7H07) CDR-L2 | see Table 56 |
| 239 | CD19 (8B8-7H07) CDR-L3 | see Table 56 |
| 240 | CD19 (8B8-7H07) CDR-H1 | see Table 57 |
| 241 | CD19 (8B8-7H07) CDR-H2 | see Table 57 |

TABLE C-continued (Sequences):

| SEQ ID NO: | Name | Sequence |
|---|---|---|
| 242 | CD19 (8B8-7H07) CDR-H3 | see Table 57 |
| 243 | CD19 (8B8-2B03) CDR-L1 | see Table 56 |
| 244 | CD19 (8B8-2B03) CDR-L2 | see Table 56 |
| 245 | CD19 (8B8-2B03) CDR-L3 | see Table 56 |
| 246 | CD19 (8B8-2B03) CDR-H1 | see Table 57 |
| 247 | CD19 (8B8-2B03) CDR-H2 | see Table 57 |
| 248 | CD19 (8B8-2B03) CDR-H3 | see Table 57 |
| 249 | CD19 (8B8-2B11) CDR-L1 | see Table 56 |
| 250 | CD19 (8B8-2B11) CDR-L2 | see Table 56 |
| 251 | CD19 (8B8-2B11) CDR-L3 | see Table 56 |
| 252 | CD19 (8B8-2B11) CDR-H1 | see Table 57 |
| 253 | CD19 (8B8-2B11) CDR-H2 | see Table 57 |
| 254 | CD19 (8B8-2B11) CDR-H3 | see Table 57 |
| 255 | CD19 (8B8-5A07) CDR-L1 | see Table 56 |
| 256 | CD19 (8B8-5A07) CDR-L2 | see Table 56 |
| 257 | CD19 (8B8-5A07) CDR-L3 | see Table 56 |
| 258 | CD19 (8B8-5A07) CDR-H1 | see Table 57 |
| 259 | CD19 (8B8-5A07) CDR-H2 | see Table 57 |
| 260 | CD19 (8B8-5A07) CDR-H3 | see Table 57 |
| 261 | CD19 (8B8-5B08) CDR-L1 | see Table 56 |
| 262 | CD19 (8B8-5B08) CDR-L2 | see Table 56 |
| 263 | CD19 (8B8-5B08) CDR-L3 | see Table 56 |
| 264 | CD19 (8B8-5B08) CDR-H1 | see Table 57 |
| 265 | CD19 (8B8-5B08) CDR-H2 | see Table 57 |
| 266 | CD19 (8B8-5B08) CDR-H3 | see Table 57 |
| 267 | CD19 (8B8-5D08) CDR-L1 | see Table 56 |
| 268 | CD19 (8B8-5D08) CDR-L2 | see Table 56 |
| 269 | CD19 (8B8-5D08) CDR-L3 | see Table 56 |
| 270 | CD19 (8B8-5D08) CDR-H1 | see Table 57 |
| 271 | CD19 (8B8-5D08) CDR-H2 | see Table 57 |
| 272 | CD19 (8B8-5D08) CDR-H3 | see Table 57 |
| 273 | nucleotide sequence CD19 (8B8) parental light chain | see Table 58 |
| 274 | nucleotide sequence CD19 (8B8) parental heavy chain | see Table 58 |
| 275 | CD19 (8B8) parental light chain | see Table 58 |
| 276 | CD19 (8B8) parental heavy chain | see Table 58 |

TABLE C-continued (Sequences):

| SEQ ID NO: | Name | Sequence |
|---|---|---|
| 277 | nucleotide sequence CD19 (8B8-2B11) light chain | see Table 59 |
| 278 | nucleotide sequence CD19 (8B8-2B11) heavy chain | see Table 59 |
| 279 | CD19 (8B8-2B11) light chain | see Table 59 |
| 280 | CD19 (8B8-2B11) heavy chain | see Table 59 |
| 281 | nucleotide sequence CD19 (8B8-7H07) light chain | see Table 59 |
| 282 | nucleotide sequence CD19 (8B8-7H07) heavy chain | see Table 59 |
| 283 | CD19 (8B8-7H07) light chain | see Table 59 |
| 284 | CD19 (8B8-7H07) heavy chain | see Table 59 |
| 285 | nucleotide sequence CD19 (8B8-2B03) light chain | see Table 59 |
| 286 | nucleotide sequence CD19 (8B8-2B03) heavy chain | see Table 59 |
| 287 | CD19 (8B8-2B03) light chain | see Table 59 |
| 288 | CD19 (8B8-2B03) heavy chain | see Table 59 |
| 289 | nucleotide sequence CD19 (8B8-5A07) light chain | see Table 59 |
| 290 | nucleotide sequence CD19 (8B8-5A07) heavy chain | see Table 59 |
| 291 | CD19 (8B8-5A07) light chain | see Table 59 |
| 292 | CD19 (8B8-5A07) heavy chain | see Table 59 |
| 293 | nucleotide sequence CD19 (8B8-5D08) light chain | see Table 59 |
| 294 | nucleotide sequence CD19 (8B8-5D08) heavy chain | see Table 59 |
| 295 | CD19 (8B8-5D08) light chain | see Table 59 |
| 296 | CD19 (8B8-5D08) heavy chain | see Table 59 |
| 297 | nucleotide sequence CD19 (8B8-5B08) light chain | see Table 59 |
| 298 | nucleotide sequence CD19 (8B8-5B08) heavy chain | see Table 59 |
| 299 | CD19 (8B8-5B08) light chain | see Table 59 |
| 300 | CD19 (8B8-5B08) heavy chain | see Table 59 |
| 301 | nucleotide sequence CD19 (8B8-5H09) light chain | see Table 59 |

TABLE C-continued (Sequences):

| SEQ ID NO: | Name | Sequence |
|---|---|---|
| 302 | nucleotide sequence CD19 (8B8-5H09) heavy chain | see Table 59 |
| 303 | CD19 (8B8-5H09) light chain | see Table 59 |
| 304 | CD19 (8B8-5H09) heavy chain | see Table 59 |
| 305 | Nucleotide sequence anti-CD19(8B8-2B11) Fc hole chain | see Table 62 |
| 306 | anti-CD19(8B8-2B11) Fc hole chain | see Table 62 |
| 307 | Nucleotide sequence anti-CD19(8B8-2B11) Fc hole dimeric ligand chain | see Table 64 |
| 308 | Nucleotide sequence anti-CD19(8B8-2B11) Fc knob monomeric ligand | see Table 64 |
| 309 | anti-CD19(8B8-2B11) Fc hole dimeric ligand chain | see Table 64 |
| 310 | anti-CD19(8B8-2B11) Fc knob monomeric ligand | see Table 64 |
| 311 | Nucleotide sequence anti-CD19(8B8-2B11) Fc hole dimeric ligand (71-248) chain | see Table 67 |
| 312 | Nucleotide sequence anti-CD19(8B8-2B11) Fc knob monomeric (71-248) ligand | see Table 67 |
| 313 | anti-CD19(8B8-2B11) Fc hole dimeric ligand (71-248) chain | see Table 67 |
| 314 | anti-CD19(8B8-2B11) Fc knob monomeric (71-248) ligand | see Table 67 |
| 315 | nucleotide sequence CD19(8B8-018) heavy chain (huIgG1 PGLALA) | see Table 72 |
| 316 | CD19(8B8-018) heavy chain (huIgG1 PGLALA) | see Table 72 |
| 317 | anti-mu CEA T84.66 VH | MKCSWVIFFL MAVVTGVNSE VQLQQSGAEL VEPGASVKLS CTASGFNIKD TYMHWVKQRP EQGLEWIGRI DPANGNSKYV PKFQGKATIT ADTSSNTAYL QLTSLTSEDT AVYYCAPFGY YVSDYAMAYW GQGTSVTVSS |
| 318 | anti-mu CEA T84.66 VL | METDTLLLWV LLLWVPGSTG DIVLTQSPAS LAVSLGQRAT MSCRAGESVD IFGVGFLHWY QQKPGQPPKL LIYRASNLES GIPVRFSGTG SRTDFTLIID PVEADDVATY YCQQTNEDPY TFGGGTKLEI K |
| 319 | IGHV1-69*08 IMGT Acc No. Z14309 | TAAGGGGCTT CCTAGTCCTA AGGCTGAGGA AGGGATCCTG GTTTAGTTAA AGAGGATTTT ATTCACCCCT GTGTCCTCTC CACAGGTGTC CAGTCCCAGG TCCAGCTGGT GCAATCTGGG GCTGAGGTGA AGAAGCCTGG GTCCTCGGTG AAGGTCTCCT GCAAGGCTTC TGGAGGCACC TTCAGCAGCT ATACTATCAG CTGGGTGCGA CAGGCCCCTG ACAAGGGCT TGAGTGGATG |

TABLE C-continued (Sequences):

| SEQ ID NO: | Name | Sequence |
|---|---|---|
| | | GGAAGGATCA TCCCTATCCT TGGTACAGCA AACTACGCAC AGAAGTTCCA GGGCAGAGTC ACGATTACCG CGGACAAATC CACGAGCACA GCCTACATGG AGCTGAGCAG CCTGAGATCT GAGGACACGG CCGTGTATTA CTGTGCGAGA GA |
| 320 | IGKV3-11*01 IMGT Acc No. | CTGCAGCTGG AAGCTCAGCT CCCACCCAGC TGCTTTGCAT GTCCCTCCCA GCTGCCCTAC CTTCCAGAGC CCATATCAAT GCCTGTGTCA GAGCCCTGGG GAGGAACTGC TCAGTTAGGA CCCAGAGGGA ACCATGGAAG CCCCAGCTCA GCTTCTCTTC CTCCTGCTAC TCTGGCTCCC AGGTGAGGGG AACATGAGGT GGTTTTGCAC ATTAGTGAAA ACTCTTGCCA CCTCTGCTCA GCAAGAAATA TAATTAAAAT TCAAAGTATA TCAACAATTT TGGCTCTACT CAAAGACAGT TGGTTTGATC TTGATTACAT GAGTGCATTT CTGTTTTATT TCCAATTTCA GATACCACCG GAGAAATTGT GTTGACACAG TCTCCAGCCA CCCTGTCTTT GTCTCCAGGG GAAAGAGCCA CCCTCTCCTG CAGGGCCAGT CAGAGTGTTA GCAGCTACTT AGCCTGGTAC CAACAGAAAC CTGGCCAGGC TCCCAGGCTC CTCATCTATG ATGCATCCAA CAGGGCCACT GGCATCCCAG CCAGGTTCAG TGGCAGTGGG TCTGGGACAG ACTTCACTCT CACCATCAGC AGCCTAGAGC CTGAAGATTT TGCAGTTTAT TACTGTCAGC AGCGTAGCAA CTGGCCTCCC ACAGTGATTC CACATGAAAC AAAAACCCCA ACAAGACCAT CAGTGTTTAC TAGATTATTA TACCAGCTGC TTCCTTTACA GACAGCTAGT GGGGTGGCCA CTCAGTGTTA GCATCTCAGC TCTATTTGGC CATTTTGGAG TTCAAGT |
| 321 | CEA CDR-H1 | see Table 81 |
| 322 | CEA CDR-H2 | see Table 81 |
| 323 | CEA CDR-H3 | see Table 81 |
| 324 | CEA CDR-L1 | see Table 81 |
| 325 | CEA CDR-L2 | see Table 81 |
| 326 | CEA CDR-L3 | see Table 81 |
| 327 | Parental CEA binder VH | see Table 81 |
| 328 | Parental CEA binder VL | see Table 81 |
| 329 | Humanized CEA binder VH | see Table 81 |
| 330 | Humanized CEA binder VL | see Table 81 |
| 331 | Nucleotide sequence anti-CEA(T84.66-LCHA) Fc hole chain | see Table 82 |
| 332 | Nucleotide sequence anti-CEA(T84.66-LCHA) light chain | see Table 82 |
| 333 | anti-CEA (T84.66-LCHA) Fc hole chain | see Table 82 |
| 334 | anti-CEA (T84.66-LCHA) light chain | see Table 82 |
| 335 | Nucleotide sequence anti-CEA(T84.66-LCHA) Fc hole dimeric ligand chain | see Table 84 |
| 336 | Nucleotide sequence anti-CEA(T84.66-LCHA) Fc knob monomeric ligand | see Table 84 |

TABLE C-continued (Sequences):

| SEQ ID NO: | Name | Sequence |
|---|---|---|
| 337 | anti-CEA(T84.66-LCHA) Fc hole dimeric ligand chain | see Table 84 |
| 338 | anti-CEA(T84.66-LCHA) Fc knob monomeric ligand | see Table 84 |
| 339 | Nucleotide sequence anti-CEA (T84.66-LCHA) Fc hole dimeric ligand (71-248) chain | see Table 87 |
| 340 | Nucleotide sequence anti-CEA (T84.66-LCHA) Fc knob monomeric (71-248) ligand | see Table 87 |
| 341 | anti-CEA (T84.66-LCHA) Fc hole dimeric ligand (71-248) chain | see Table 87 |
| 342 | anti-CEA (T84.66-LCHA) Fc knob monomeric (71-248) ligand | see Table 87 |
| 343 | Nucleotide sequence anti-CEA(T84.66) Fc hole chain | see Table 88 |
| 344 | Nucleotide sequence anti-CEA(T84.66) light chain | see Table 88 |
| 345 | anti-CEA (T84.66) Fc hole chain | see Table 88 |
| 346 | anti-CEA (T84.66) light chain | see Table 88 |
| 347 | Nucleotide sequence anti-CEA(T84.66) Fc hole dimeric ligand chain | see Table 89 |
| 348 | Nucleotide sequence anti-CEA(T84.66) Fc knob monomeric ligand | see Table 89 |
| 349 | anti-CEA(T84.66) Fc hole dimeric ligand chain | see Table 89 |
| 350 | anti-CEA(T84.66) Fc knob monomeric ligand | see Table 89 |
| 351 | nucleotide sequence hu NA3B3A2-avi His | see Table 92 |
| 352 | human NA3B3A2-avi-His | see Table 92 |
| 353 | Nucleotide sequence Dimeric hu OX40L (51-183)-CL* Fc knob chain | see Table 97 |
| 354 | Nucleotide sequence Monomeric hu OX40L (51-183)- CH1* | see Table 97 |
| 355 | Dimeric hu OX40L (51-183)-CL* Fc knob chain | see Table 97 |
| 356 | Monomeric hu OX40L (51-183)- CH1* | see Table 97 |
| 357 | CD19 (8B8-2B11) VH | QVQLVQSGAEVKKPGASVKVSCKASGYTFTDYIMH WVRQAPGQGLEWMGYINPYNDGSKYTEKFQGRVT MTSDTSISTAYMELSRLRSDDTAVYYCARGTYYYGP QLFDYWGQGTTVTVSS |

TABLE C-continued (Sequences):

| SEQ ID NO: | Name | Sequence |
|---|---|---|
| 358 | CD19 (8B8-2B11) VL | DIVMTQTPLSLSVTPGQPASISCKSSQSLETSTGTTYL NWYLQKPGQSPQLLIYRVSKRFSGVPDRFSGSGSGTD FTLKISRVEAEDVGVYYCLQLLEDPYTFGQGTKLEIK |
| 359 | CD19 (8B8-7H07) VH | QVQLVQSGAEVKKPGASVKVSCKASGYTFTDYIMH WVRQAPGQGLEWMGYINPYNDGSKYTEKFQGRVT MTSDTSISTAYMELSRLRSDDTAVYYCARGTYYYGS ELFDYWGQGTTVTSS |
| 360 | CD19 (8B8-7H07) VL | DIVMTQTPLSLSVTPGQPASISCKSSQSLETSTGNTYL NWYLQKPGQSPQLLIYRVSKRFSGVPDRFSGSGSGTD FTLKISRVEAEDVGVYYCLQATHIPYTFGQGTKLEIK |
| 361 | CD19 (8B8-2B03) VH | QVQLVQSGAEVKKPGASVKVSCKASGYTFTDYITH WVRQAPGQGLEWMGYINPYNDGSKYTEKFQGRVT MTSDTSISTAYMELSRLRSDDTAVYYCARGTYYYGP DLFDYWGQGTTVTSS |
| 362 | CD19 (8B8-2B03) VL | DIVMTQTPLSLSVTPGQPASISCKSSQSLETSTGNTYL NWYLQKPGQSPQLLIYRVSKRFSGVPDRFSGSGSGTD FTLKISRVEAEDVGVYYCLQLTHVPYTFGQGXKLEIK |
| 363 | CD19 (8B8-5A07) VH | QVQLVQSGAEVKKPGASVKVSCKASGYTFTDYIMH WVRQAPGQGLEWMGYINPYNDGSKYTEKFQGRVT MTSDTSISTAYMELSRLRSDDTAVYYCARGTYYYGS ALFDYWGQGTTVTSS |
| 364 | CD19 (8B8-5A07) VL | DIVMTQTPLSLSVTPGQPASISCKSSQSLETSTGNTYL NWYLQKPGQSPQLLIYRVSKRFSGVPDRFSGSGSGTD FTLKISRVEAEDVGVYYCLQPGHYPGTFGQGTKLEIK |
| 365 | CD19 (8B8-5D08) VH | QVQLVQSGAEVKKPGASVKVSCKASGYTFTDYIMH WVRQAPGQGLEWMGYINPYNDGSKYTEKFQGRVT MTSDTSISTAYMELSRLRSDDTAVYYCARGTYYYGS ELFDYWGQGTTVTSS |
| 366 | CD19 (8B8-5D08) VL | DIVMTQTPLSLSVTPGQPASISCKSSQSLETSTGNTYL NWYLQKPGQSPQLLIYRVSKRFSGVPDRFSGSGSGTD FTLKISRVEAEDVGVYYCLQLTHEPYTFGQGTKLEIK |
| 367 | CD19 (8B8-5B08) VH | QVQLVQSGAEVKKPGASVKVSCKASGYTFTDYIMH WVRQAPGQGLEWMGYINPYNDGSKYTEKFQGRVT MTSDTSISTAYMELSRLRSDDTAVYYCARGTYYYGP QLFDYWGQGTTVTSS |
| 368 | CD19 (8B8-5B08) VL | DIVMTQTPLSLSVTPGQPASISCKSSQSLETSTGNTYL NWYLQKPGQSPQLLIYRVSKRFSGVPDRFSGSGSGTD FTLKISRVEAEDVGVYYCLQLDSYPNTFGQGTKLEIK |
| 369 | CD19 (8B8-5H09) VH | QVQLVQSGAEVKKPGASVKVSCKASGYTFTDYIMH WVRQAPGQGLEWMGYINPYNDGSKYTEKFQGRVT MTSDTSISTAYMELSRLRSDDTAVYYCARGTYYYGS ALFDYWGQGTTVTSS |
| 370 | CD19 (8B8-5H09) VL | DIVMTQTPLSLSVTPGQPASISCKSSQSLESSTGNTYL NWYLQKPGQSPQLLIYRVSKRFSGVPDRFSGSGSGTD FTLKISRVEAEDVGVYYCLQLIDYPVTFGQGTKLEIK |
| 371 | dimeric huOX40L (51-183) connected by (G$_4$S)$_2$ linker | QVSHRYPRIQSIKVQFTEYKKEKGFILTSQKEDEIMK VQNNSVIINCDGFYLISLKGYFSQEVNISLHYQKDEEP LFQLKKVRSVNSLMVASLTYKDKVYLNVTTDNTSL DDFHVNGGELILIHQNPGEFCVLGGGGSGGGGSQVS HRYPRIQSIKVQFTEYKKEKGFILTSQKEDEIMKVQN NSVIINCDGFYLISLKGYFSQEVNISLHYQKDEEPLFQ LKKVRSVNSLMVASLTYKDKVYLNVTTDNTSLDDF HVNGGELILIHQNPGEFCVL |
| 372 | dimeric huOX40L (52-183) connected by (G$_4$S)$_2$ linker | VSHRYPRIQSIKVQFTEYKKEKGFILTSQKEDEIMKV QNNSVIINCDGFYLISLKGYFSQEVNISLHYQKDEEPL FQLKKVRSVNSLMVASLTYKDKVYLNVTTDNTSLD DFHVNGGELILIHQNPGEFCVLGGGGSGGGGSVSHR YPRIQSIKVQFTEYKKEKGFILTSQKEDEIMKVQNNS VIINCDGFYLISLKGYFSQEVNISLHYQKDEEPLFQLK KVRSVNSLMVASLTYKDKVYLNVTTDNTSLDDFHV NGGELILIHQNPGEFCVL |

TABLE C-continued (Sequences):

| SEQ ID NO: | Name | Sequence |
|---|---|---|
| 373 | hu 4-1BBL (85-248) | LDLRQGMFAQLVAQNVLLIDGPLSWYSDPGLAGVSL TGGLSYKEDTKELVVAKAGVYYVFFQLELRRVVAG EGSGSVSLALHLQPLRSAAGAAALALTVDLPPASSEA RNSAFGFQGRLLHLSAGQRLGVHLHTEARARHAWQ LTQGATVLGLFRVTPEIPAGL |
| 374 | hu 4-1BBL (80-248) | DPAGLLDLRQGMFAQLVAQNVLLIDGPLSWYSDPGL AGVSLTGGLSYKEDTKELVVAKAGVYYVFFQLELRR VVAGEGSGSVSLALHLQPLRSAAGAAALALTVDLPP ASSEARNSAFGFQGRLLHLSAGQRLGVHLHTEARAR HAWQLTQGATVLGLFRVTPEIPAGL |
| 375 | hu 4-1BBL (52-248) | PWAVSGARASPGSAASPRLREGPELSPDDPAGLLDLR QGMFAQLVAQNVLLIDGPLSWYSDPGLAGVSLTGGL SYKEDTKELVVAKAGVYYVFFQLELRRVVAGEGSG SVSLALHLQPLRSAAGAAALALTVDLPPASSEARNSA FGFQGRLLHLSAGQRLGVHLHTEARARHAWQLTQG ATVLGLFRVTPEIPAGL |

General information regarding the nucleotide sequences of human immunoglobulins light and heavy chains is given in: Kabat, E. A., et al., Sequences of Proteins of Immunological Interest, 5th ed., Public Health Service, National Institutes of Health, Bethesda, Md. (1991).

Amino acids of antibody chains are numbered and referred to according to the EU numbering systems according to Kabat (Kabat, E. A., et al., Sequences of Proteins of Immunological Interest, 5th ed., Public Health Service, National Institutes of Health, Bethesda, Md. (1991)) as defined above.

EXAMPLES

The following are examples of methods and compositions of the invention. It is understood that various other embodiments may be practiced, given the general description provided above.

Recombinant DNA Techniques

Standard methods were used to manipulate DNA as described in Sambrook et al., Molecular cloning: A laboratory manual; Cold Spring Harbor Laboratory Press, Cold Spring Harbor, N.Y., 1989. The molecular biological reagents were used according to the manufacturer's instructions. General information regarding the nucleotide sequences of human immunoglobulin light and heavy chains is given in: Kabat, E. A. et al., (1991) Sequences of Proteins of Immunological Interest, Fifth Ed., NIH Publication No 91-3242.

DNA Sequencing

DNA sequences were determined by double strand sequencing.

Gene Synthesis

Desired gene segments were either generated by PCR using appropriate templates or were synthesized by Geneart AG (Regensburg, Germany) from synthetic oligonucleotides and PCR products by automated gene synthesis. In cases where no exact gene sequence was available, oligonucleotide primers were designed based on sequences from closest homologues and the genes were isolated by RT-PCR from RNA originating from the appropriate tissue. The gene segments flanked by singular restriction endonuclease cleavage sites were cloned into standard cloning/sequencing vectors. The plasmid DNA was purified from transformed bacteria and concentration determined by UV spectroscopy. The DNA sequence of the subcloned gene fragments was confirmed by DNA sequencing. Gene segments were designed with suitable restriction sites to allow sub-cloning into the respective expression vectors. All constructs were designed with a 5'-end DNA sequence coding for a leader peptide which targets proteins for secretion in eukaryotic cells.

Cell Culture Techniques

Standard cell culture techniques were used as described in Current Protocols in Cell Biology (2000), Bonifacino, J. S., Dasso, M., Harford, J. B., Lippincott-Schwartz, J. and Yamada, K. M. (eds.), John Wiley & Sons, Inc.

Protein Purification

Proteins were purified from filtered cell culture supernatants referring to standard protocols. In brief, antibodies were applied to a Protein A Sepharose column (GE healthcare) and washed with PBS. Elution of antibodies was achieved at pH 2.8 followed by immediate neutralization of the sample. Aggregated protein was separated from monomeric antibodies by size exclusion chromatography (Superdex 200, GE Healthcare) in PBS or in 20 mM Histidine, 150 mM NaCl pH 6.0. Monomeric antibody fractions were pooled, concentrated (if required) using e.g., a MILLIPORE Amicon Ultra (30 MWCO) centrifugal concentrator, frozen and stored at −20° C. or −80° C. Part of the samples were provided for subsequent protein analytics and analytical characterization e.g. by SDS-PAGE, size exclusion chromatography (SEC) or mass spectrometry.

SDS-PAGE

The NuPAGE® Pre-Cast gel system (Invitrogen) was used according to the manufacturer's instruction. In particular, 10% or 4-12% NuPAGE® Novex® Bis-TRIS Pre-Cast gels (pH 6.4) and a NuPAGE® MES (reduced gels, with NuPAGE® Antioxidant running buffer additive) or MOPS (non-reduced gels) running buffer was used.

Analytical Size Exclusion Chromatography

Size exclusion chromatography (SEC) for the determination of the aggregation and oligomeric state of antibodies was performed by HPLC chromatography. Briefly, Protein A purified antibodies were applied to a Tosoh TSKGEL® G3000SW column in 300 mM NaCl, 50 mM $KH_2PO_4$/

K$_2$HPO$_4$, pH 7.5 on an Agilent HPLC 1100 system or to a Superdex 200 column (GE Healthcare) in 2×PBS on a Dionex HPLC-System. The eluted protein was quantified by UV absorbance and integration of peak areas. BioRad Gel Filtration Standard 151-1901 served as a standard.

Mass Spectrometry

This section describes the characterization of the multispecific antibodies with VH/VL exchange (VH/VL Cross-Mabs) with emphasis on their correct assembly. The expected primary structures were analyzed by electrospray ionization mass spectrometry (ESI-MS) of the deglycosylated intact CrossMabs and deglycosylated/plasmin digested or alternatively deglycosylated/limited LysC digested Cross-Mabs.

The VH/VL CrossMabs were deglycosylated with N-Glycosidase F in a phosphate or Tris buffer at 37° C. for up to 17 h at a protein concentration of 1 mg/ml. The plasmin or limited LysC (Roche) digestions were performed with 100 μg deglycosylated VH/VL CrossMabs in a Tris buffer pH 8 at room temperature for 120 hours and at 37° C. for 40 min, respectively. Prior to mass spectrometry the samples were desalted via HPLC on a Sephadex G25 column (GE Healthcare). The total mass was determined via ESI-MS on a maXis 4G UHR-QTOF MS system (Bruker Daltonik) equipped with a TriVersa NanoMate source (Advion).

Determination of Binding and Binding Affinity of Multispecific Antibodies to the Respective Antigens Using Surface Plasmon Resonance (SPR) (BIACORE®)

Binding of the generated antibodies to the respective antigens is investigated by surface plasmon resonance using a BIACORE® instrument (GE Healthcare Biosciences AB, Uppsala, Sweden). Briefly, for affinity measurements Goat-Anti-Human IgG, JIR 109-005-098 antibodies are immobilized on a CM5 chip via amine coupling for presentation of the antibodies against the respective antigen. Binding is measured in HBS buffer (HBS-P (10 mM HEPES, 150 mM NaCl, 0.005% Tween 20, ph 7.4), 25° C. (or alternatively at 37° C.). Antigen (R&D Systems or in house purified) was added in various concentrations in solution. Association was measured by an antigen injection of 80 seconds to 3 minutes; dissociation was measured by washing the chip surface with HBS buffer for 3-10 minutes and a KD value was estimated using a 1:1 Langmuir binding model. Negative control data (e.g. buffer curves) are subtracted from sample curves for correction of system intrinsic baseline drift and for noise signal reduction. The respective Biacore Evaluation Software is used for analysis of sensorgrams and for calculation of affinity data.

Example 1

1.1 Preparation of Targeted Human 4-1BB Ligand Trimer-Containing Fc Fusion Antigen Binding Molecules Different fragments of the DNA sequence encoding part of the ectodomain (amino acids 71-254, 52-254 and 80-254) of human 4-1BB ligand were synthesized according to the P41273 sequence of Uniprot database (SEQ ID NO:42).

Figure 1A:
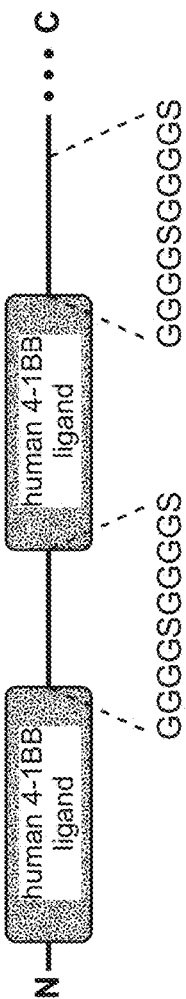
FIGS. 1A to 1D show the components for the assembly of split trimeric human 4-1BB ligands including linker GGGGSGGGGS (SEQ ID NO:13).
Figure 1B:
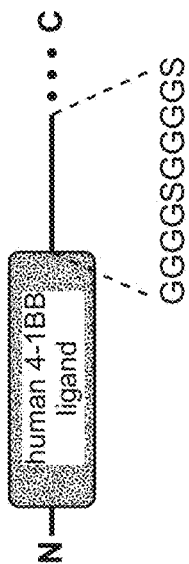
Figure 1C:
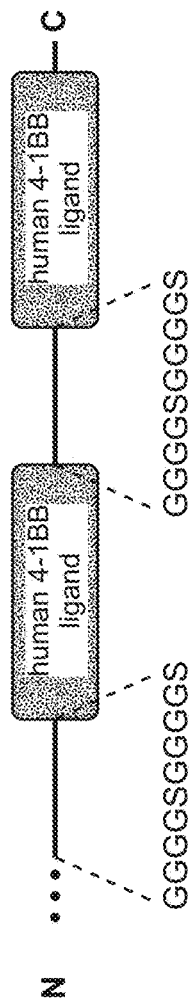

As components for the assembly of a TNF ligand trimer-containing antigen binding molecule a polypeptide comprising two ectodomains of 4-1BB ligand, separated by (G$_4$S)$_2$ (SEQ ID NO:13) linkers, and fused to the human IgG1-CH1 or CL domain, was cloned as depicted in FIG. 1A—(human 4-1BB ligand, (G$_4$S)$_2$ (SEQ ID NO:13) connector, human 4-1BB ligand, (G$_4$S)$_2$ (SEQ ID NO:13) connector, human CH1 or CL) or as depicted in FIG. 1C (human CH3, (G$_4$S)$_2$ (SEQ ID NO:13) connector, human 4-1BB ligand, (G$_4$S)$_2$ (SEQ ID NO:13) connector, human 4-1BB ligand).

Figure 1D:
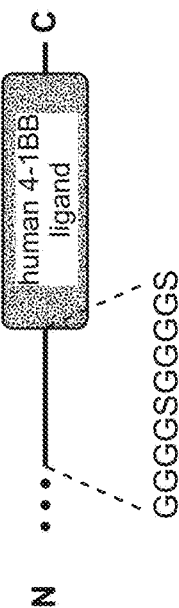

A polypeptide comprising one ectodomain of 4-1BB ligand and fused to the human IgG1-CL or CH1 domain, was cloned as described in FIG. 1B (human 4-1BB ligand, (G$_4$S)$_2$ (SEQ ID NO:13) connector, human CL or CH1) or as depicted in FIG. 1D (human CH3, (G$_4$S)$_2$ (SEQ ID NO:13) connector, human 4-1BB ligand).

The polypeptides were subcloned in frame with the human IgG1 heavy chain CH2 and CH3 domains with optional peptide linkers, for example for construct 1 the polypeptide encoding the dimeric 4-1BB ligand fused to a human CH1 domain was subcloned in frame with the human IgG1 heavy chain CH2 and CH3 domains on the knob (Merchant, Zhu et al. 1998) using a linker (G$_4$S)$_2$ of SEQ ID NO:13 or GSPGSSSSGS of SEQ ID NO:57.

The variable region of heavy and light chain DNA sequences encoding a binder specific for fibroblast activation protein (FAP), i.e. 28H1, were subcloned in frame with either the constant heavy chain of the hole (Carter, J. Immunol. Methods (2001), 248, 7-15) or the constant light chain of human IgG1. The generation and preparation of the FAP binders is described in WO 2012/020006 A2, which is incorporated herein by reference.

Table 1 summarizes the characteristics of the constructs produced. The constructs 1 to 10 differ in their geometry, valency for FAP, 4-1BB ligand ectodomain, crossover of the CH1 and CL domain (CrossMab technology), mutations in the CH1 and CL domains and different peptide linkers in the polypeptide comprising one ectodomain of 4-1BB ligand (monomeric 4-1BBL chain).

TABLE 1

Characteristics of produced TNF ligand trimer-containing antigen binding molecules (FAP split 4-1BBL trimers)

| Construct | Valency for FAP | FAP binder | 4-1BBL ectodomain | Crossed CH1-CL domains | Charged residues | Linker to 4-1BBL in light chain |
|---|---|---|---|---|---|---|
| 1.1 | monovalent | 28H1 | 71-254 | no | no | (G$_4$S)$_2$ (SEQ ID NO: 13) |
| 1.2 | monovalent | 28H1 | 71-254 | yes (Ligand) | yes (Ligand) | (G$_4$S)$_2$ (SEQ ID NO: 13) |
| 1.3 | monovalent | 28H1 | 71-254 | yes (FAP Fab) | yes (Ligand) | (G$_4$S)$_2$ (SEQ ID NO: 13) |
| 1.4 | monovalent | 28H1 | 71-254 | no | yes (Ligand) | (G$_4$S)$_2$ (SEQ ID NO: 13) |

TABLE 1-continued

Characteristics of produced TNF ligand trimer-containing antigen binding molecules
(FAP split 4-1BBL trimers)

| Construct | Valency for FAP | FAP binder | 4-1BBL ectodomain | Crossed CH1-CL domains | Charged residues | Linker to 4-1BBL in light chain |
|---|---|---|---|---|---|---|
| 1.5 | bivalent | 28H1 | 71-254 | no | no | $(G_4S)_2$ (SEQ ID NO: 13) |
| 1.6 | monovalent | 28H1 | 71-254 | no | yes (Ligand) | $(G_4S)_1$ (SEQ ID NO: 128) |
| 1.7 | bivalent | 28H1 | 71-254 | yes (Ligand) | yes (Ligand) | $(G_4S)_2$ (SEQ ID NO: 13) |
| 1.8 | bivalent | 28H1 | 71-254 | yes (FAP Fab fused to Ligand) | yes (Ligand) | $(G_4S)_2$ (SEQ ID NO: 13) |
| 1.9 | monovalent | 28H1 | 52-254 | no | yes (Ligand) | $(G_4S)_2$ (SEQ ID NO: 13) |
| 1.10 | monovalent | 28H1 | 80-254 | no | yes (Ligand) | $(G_4S)_2$ (SEQ ID NO: 13) |

In order to avoid mispairing, in most of the constructs one pair of CH1 and CL domains was replaced by each other (domain crossover) as described in WO 2009/080253 A1.

To further improve correct pairing, different charged amino acid substitutions were introduced in the crossed or non-crossed CH1 and CL domains as charged residues in constructs 2 to 4 and 6 to 10. In the human CL domain the mutations E123R and Q124K were introduced, whereas the mutations K147E and K213E were cloned into the human CH1 domain.

For all constructs the knobs into holes heterodimerization technology was used with the S354C/T366W mutations in the CH3 domain of the knob chain and the corresponding Y349C/T366S/L368A/Y407V mutations in the CH3 domain of the hole chain (Carter, J Immunol Methods 248, 7-15 (2001)).

The Pro329Gly, Leu234Ala and Leu235Ala mutations have been introduced in the constant region of the knob and hole heavy chains to abrogate binding to Fc gamma receptors according to the method described in International Patent Appl. Publ. No. WO 2012/130831 A1.

Figure 2G:
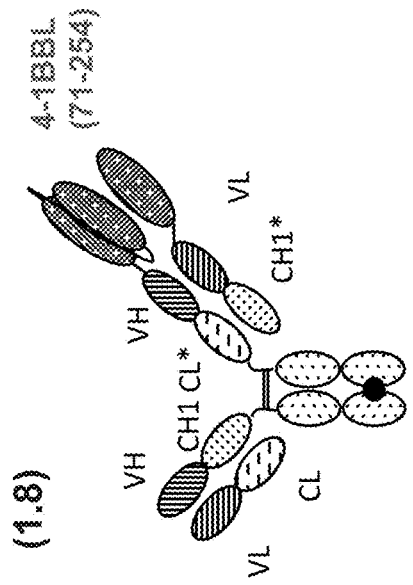

For example, in construct 1 the combination of the ligand-Fc knob chain containing the S354C/T366W mutations in the first CH3 domain, with the targeted anti-FAP-Fc hole chain containing the Y349C/T366S/L368A/Y407V mutations in the second CH3 domain allows generation of a heterodimer, which includes an assembled trimeric 4-1BB ligand and a FAP binding Fab (FIG. 2A, Construct 1.1).

Table 2 shows the cDNA and amino acid sequences of the monovalent FAP-targeted 4-1BB ligand trimer-containing Fc (kih) fusion antigen binding molecule (Construct 1.1).

TABLE 2

Sequences of FAP-targeted human 4-1BB ligand trimer
containing Fc (kih) fusion molecule Construct 1.1

| SEQ ID NO: | Description | Sequence |
|---|---|---|
| 66 | Dimeric hu 4-1BBL (71-254)-CH1 Fc knob chain | AGAGAGGGCCCTGAGCTGAGCCCCGATGATCCTGCTGG<br>ACTGCTGGACCTGCGGCAGGGCATGTTTGCTCAGCTGGT<br>GGCCCAGAACGTGCTGCTGATCGATGGCCCCCTGTCCTG<br>GTACAGCGATCCTGGACTGGCTGGCGTGTCACTGACAGG<br>CGGCCTGAGCTACAAAGAGGACACCAAAGAACTGGTGG<br>TGGCCAAGGCCGGCGTGTACTACGTGTTCTTTCAGCTGG<br>AACTGCGGAGAGTGGTGGCCGGCGAAGGATCTGGCTCT<br>GTGTCTCTGGCCCTGCATCTGCAGCCTCTGAGAAGCGCT<br>GCTGGCGCTGCAGCTCTGGCACTGACAGTGGATCTGCCT<br>CCTGCCAGCTCCGAGGCCCGGAATAGCGCATTTGGGTTT<br>CAAGGCAGGCTGCTGCACCTGTCTGCCGGCCAGAGGCT<br>GGGAGTGCATCTGCACACAGAGGCCAGGGCTAGACACG<br>CCTGGCAGCTGACACAGGGCGCTACAGTGCTGGGCCTG<br>TTCAGAGTGACCCCCGAGATTCCAGCCGGCCTGCCTTCT<br>CCAAGAAGCGAAGGCGGAGGCGGATCTGGCGGCGAG<br>GATCTAGAGAGGGACCCGAACTGTCCCCTGACGATCCA<br>GCCGGGCTGCTGGATCTGAGACAGGGAATGTTCGCCCA<br>GCTGGTGGCTCAGAATGTGCTGCTGATTGACGGACCTCT<br>GAGCTGGTACTCCGACCCAGGGCTGGCAGGGGTGTCCC<br>TGACTGGGGGACTGTCCTACAAAGAAGATACAAAAGAA<br>CTGGTGGTGGCTAAAGCTGGGGTGTACTATGTGTTTTTT<br>CAGCTGGAACTGAGGCGGGTGGTGGCTGGGGAGGGCTC<br>AGGATCTGTGTCCCTGGCTCTGCATCTGCAGCCACTGCG |

TABLE 2-continued

Sequences of FAP-targeted human 4-1BB ligand trimer containing Fc (kih) fusion molecule Construct 1.1

| SEQ ID NO: | Description | Sequence |
|---|---|---|
|  |  | CTCTGCTGCTGGCGCAGCTGCACTGGCTCTGACTGTGGA CCTGCCACCAGCCTCTAGCGAGGCCAGAAACAGCGCCT TCGGGTTCCAAGGACGCCTGCTGCATCTGAGCGCCGGAC AGCGCCTGGGAGTGCATCTGCATACTGAAGCCAGAGCC CGGCATGCTTGGCAGCTGACTCAGGGGGCAACTGTGCTG GGACTGTTTCGCGTGACACCTGAGATCCCTGCCGGACTG CCAAGCCCTAGATCAGAAGGGGGCGGAGGAAGCGGAG GGGGAGGAAGTGCTAGCACCAAGGGCCCTAGCGTGTTC CCTCTGGCCCCTAGCAGCAAGAGCACAAGTGGAGGAAC AGCCGCCCTGGGCTGCCTGGTCAAGGACTACTTCCCCGA GCCCGTGACCGTGTCCTGGAATTCTGGCGCCCTGACAAG CGGCGTGCACACATTTCCAGCCGTGCTGCAGAGCAGCG GCCTGTACTCTCTGAGCAGCGTCGTGACCGTGCCCTCTA GCTCTCTGGGCACCCAGACCTACATCTGCAACGTGAACC ACAAGCCCAGCAACACCAAAGTGGACAAGAAGGTGGA ACCCAAGAGCTGCGACAAGACCCACACCTGTCCCCCTTG CCCTGCCCCTGAAGCTGCTGGTGGCCCTTCCGTGTTCCT GTTCCCCCCAAAGCCCAAGGACACCCTGATGATCAGCC GGACCCCCGAAGTGACCTGCGTGGTGGTCGATGTGTCCC ACGAGGACCCTGAAGTGAAGTTCAATTGGTACGTGGAC GGCGTGGAAGTGCACAATGCCAAGACCAAGCCGCGGGA GGAGCAGTACAACAGCACGTACCGTGTGGTCAGCGTCC TCACCGTCCTGCACCAGGACTGGCTGAATGGCAAGGAG TACAAGTGCAAGGTCTCCAACAAAGCCCTCGGCGCCCC CATCGAGAAACCATCTCCAAAGCCAAGGGCAGCCCC GAGAACCACAGGTGTACACCCTGCCCCCATGCCGGGAT GAGCTGACCAAGAACCAGGTCAGCCTGTGGTGCCTGGT CAAAGGCTTCTATCCCAGCGACATCGCCGTGGAGTGGG AGAGCAATGGGCAGCCGGAGAACAACTACAAGACCACG CCTCCCGTGCTGGACTCCGACGGCTCCTTCTTCCTCTACA GCAAGCTCACCGTGGACAAGAGCAGGTGGCAGCAGGGG AACGTCTTCTCATGCTCCGTGATGCATGAGGCTCTGCAC AACCACTACACGCAGAAGAGCCTCTCCCTGTCTCCGGGT AAA |
| 67 | Monomeric hu 4-1BBL (71-254)-CL | AGAGAGGGCCCTGAGCTGAGCCCCGATGATCCTGCTGG ACTGCTGGACCTGCGGCAGGGCATGTTTGCTCAGCTGGT GGCCCAGAACGTGCTGCTGATCGATGGCCCCCTGTCCTG GTACAGCGATCCTGGACTGGCTGGCGTGTCACTGACAGG CGGCCTGAGCTACAAAGAGGACACCAAAGAACTGGTGG TGGCCAAGGCCGGCGTGTACTACGTGTTCTTTCAGCTGG AACTGCGGAGAGTGGTGGCCGGCGAAGGATCTGGCTCT GTGTCTCTGGCCCTGCATCTGCAGCCTCTGAGAAGCGCT GCTGGCGCTGCAGCTCTGGCACTGACAGTGGATCTGCCT CCTGCCAGCTCCGAGGCCCGGAATAGCGCATTTGGGTTT CAAGGCAGGCTGCTGCACCTGTCTGCCGGCCAGAGGCT GGGAGTGCATCTGCACACAGAGGCCAGGGCTAGACACG CCTGGCAGCTGACACAGGGCGCTACAGTGCTGGGCCTG TTCAGAGTGACCCCCGAGATTCCAGCCGGCCTGCCTTCT CCAAGAAGCGAAGGCGGAGGCGGATCTGGCGGCGGAG GATCTCGTACGGTGGCTGCACCATCTGTCTTCATCTTCCC GCCATCTGATGAGCAGTTGAAATCTGGAACTGCCTCTGT TGTGTGCCTGCTGAATAACTTCTATCCCAGAGAGGCCAA AGTACAGTGGAAGGTGGATAACGCCCTCCAATCGGGTA ACTCCCAGGAGAGTGTCACAGAGCAGGACAGCAAGGAC AGCACCTACAGCCTCAGCAGCACCCTGACGCTGAGCAA AGCAGACTACGAGAAACACAAAGTCTACGCCTGCGAAG TCACCCATCAGGGCCTGAGCTCGCCCGTCACAAAGAGCT TCAACAGGGGAGAGTGT |
| 68 | anti-FAP Fc hole chain | GAAGTGCAGCTGCTGGAATCCGGCGGAGGCCTGGTGCA GCCTGGCGGATCTCTGAGACTGTCCTGCGCCGCCTCCGG CTTCACCTTCTCCTCCCACGCCATGTCCTGGGTCCGACA GGCTCCTGGCAAAGGCCTGGAATGGGTGTCCGCCATCTG GGCCTCCGGCGAGCAGTACGCCGACTCTGTGAAGG GCCGGTTCACCATCTCCCGGGACAACTCCAAGAACACCC TGTACCTGCAGATGAACTCCCTGCGGGCCGAGGACACC GCCGTGTACTACTGTGCCAAGGGCTGGCTGGGCAACTTC GACTACTGGGGACAGGGCACCCTGGTCACCGTGTCCAG CGCTAGCACCAAGGGCCCCTCCGTGTTCCCCCTGGCCCC CAGCAGCAAGAGCACCAGCGGCGGCACAGCCGCTCTGG GCTGCCTGGTCAAGGACTACTTCCCCGAGCCCGTGACCG TGTCCTGGAACAGCGGAGCCCTGACCTCCGGCGTGCAC ACCTTCCCGGCCGTGCTGCAGAGTTCTGGCCTGTATAGC |

TABLE 2-continued

Sequences of FAP-targeted human 4-1BB ligand trimer
containing Fc (kih) fusion molecule Construct 1.1

| SEQ ID NO: | Description | Sequence |
|---|---|---|
| | | CTGAGCAGCGTGGTCACCGTGCCTTCTAGCAGCCTGGGC<br>ACCCAGACCTACATCTGCAACGTGAACCACAAGCCCAG<br>CAACACCAAGGTGGACAAGAAGGTGGAGCCCAAGAGCT<br>GCGACAAAACTCACACATGCCCACCGTGCCCAGCACCT<br>GAAGCTGCAGGGGACCGTCAGTCTTCCTCTTCCCCCCA<br>AAACCCAAGGACACCCTCATGATCTCCCGGACCCCTGA<br>GGTCACATGCGTGGTGGTGGACGTGAGCCACGAAGACC<br>CTGAGGTCAAGTTCAACTGGTACGTGGACGGCGTGGAG<br>GTGCATAATGCCAAGACAAAGCCGCGGGAGGAGCAGTA<br>CAACAGCACGTACCGTGTGGTCAGCGTCCTCACCGTCCT<br>GCACCAGGACTGGCTGAATGGCAAGGAGTACAAGTGCA<br>AGGTCTCCAACAAAGCCCTCGGCGCCCCCATCGAGAAA<br>ACCATCTCCAAAGCCAAAGGGCAGCCCCGAGAACCACA<br>GGTGTGCACCCTGCCCCCATCCCGGGATGAGCTGACCAA<br>GAACCAGGTCAGCCTCTCGTGCGCAGTCAAAGGCTTCTA<br>TCCCAGCGACATCGCCGTGGAGTGGGAGAGCAATGGGC<br>AGCCGGAGAACAACTACAAGACCACGCCTCCCGTGCTG<br>GACTCCGACGGCTCCTTCTTCCTCGTGAGCAAGCTCACC<br>GTGGACAAGAGCAGGTGGCAGCAGGGGAACGTCTTCTC<br>ATGCTCCGTGATGCATGAGGCTCTGCACAACCACTACAC<br>GCAGAAGAGCCTCTCCCTGTCTCCGGGTAAA |
| 69 | anti-FAP light chain | GAGATCGTGCTGACCCAGTCCCCCGGCACCCTGTCTCTG<br>AGCCCTGGCGAGAGAGCCACCCTGTCCTGCAGAGCCTC<br>CCAGTCCGTGTCCCGGTCCTACCTCGCCTGGTATCAGCA<br>GAAGCCCGGCCAGGCCCCTCGGCTGCTGATCATCGGCG<br>CCTCTACCAGAGCCACCGGCATCCCTGACCGGTTCTCCG<br>GCTCTGGCTCCGGCACCGACTTCACCCTGACCATCTCCC<br>GGCTGGAACCCGAGGACTTCGCCGTGTACTACTGCAGC<br>AGGGCCAGGTCATCCCTCCCACCTTTGGCCAGGGCACCA<br>AGGTGGAAATCAAGCGTACGGTGGCTGCACCATCTGTCT<br>TCATCTTCCCGCCATCTGATGAGCAGTTGAAATCTGGAA<br>CTGCCTCTGTTGTGTGCCTGCTGAATAACTTCTATCCCAG<br>AGAGGCCAAAGTACAGTGGAAGGTGGATAACGCCCTCC<br>AATCGGGTAACTCCCAGGAGAGTGTCACAGAGCAGGAC<br>AGCAAGGACAGCACCTACAGCCTCAGCAGCACCCTGAC<br>GCTGAGCAAAGCAGACTACGAGAAACACAAAGTCTACG<br>CCTGCGAAGTCACCCATCAGGGCCTGAGCTCGCCCGTCA<br>CAAAGAGCTTCAACAGGGGAGAGTGT |
| 14 | Dimeric hu 4-1BBL (71-254)-CH1 Fc knob chain | REGPELSPDDPAGLLDLRQGMFAQLVAQNVLLIDGPLSWY<br>SDPGLAGVSLTGGLSYKEDTKELVVAKAGVYYVFFQLELR<br>RVVAGEGSGSVSLALHLQPLRSAAGAAALALTVDLPPASS<br>EARNSAFGFQGRLLHLSAGQRLGVHLHTEARARHAWQLT<br>QGATVLGLFRVTPEIPAGLPSPRSEGGGGSGGGGSREGPEL<br>SPDDPAGLLDLRQGMFAQLVAQNVLLIDGPLSWYSDPGLA<br>GVSLTGGLSYKEDTKELVVAKAGVYYVFFQLELRRVVAG<br>EGSGSVSLALHLQPLRSAAGAAALALTVDLPPASSEARNS<br>AFGFQGRLLHLSAGQRLGVHLHTEARARHAWQLTQGATV<br>LGLFRVTPEIPAGLPSPRSEGGGGSGGGGSASTKGPSVFPLA<br>PSSKSTSGGTAALGCLVKDYFPEPVTVSWNSGALTSGVHT<br>FPAVLQSSGLYSLSSVVTVPSSSLGTQTYICNVNHKPSNTK<br>VDKKVEPKSCDKTHTCPPCPAPEAAGGPSVFLFPPKPKDTL<br>MISRTPEVTCVVVDVSHEDPEVKFNWYVDGVEVHNAKTK<br>PREEQYNSTYRVVSVLTVLHQDWLNGKEYKCKVSNKALG<br>APIEKTISKAKGQPREPQVYTLPPCRDELTKNQVSLWCLVK<br>GFYPSDIAVEWESNGQPENNYKTTPPVLDSDGSFFLYSKLT<br>VDKSRWQQGNVFSCSVMHEALHNHYTQKSLSLSPGK |
| 15 | Monomeric hu 4-1BBL (71-254)-CL1 | REGPELSPDDPAGLLDLRQGMFAQLVAQNVLLIDGPLSWY<br>SDPGLAGVSLTGGLSYKEDTKELVVAKAGVYYVFFQLELR<br>RVVAGEGSGSVSLALHLQPLRSAAGAAALALTVDLPPASS<br>EARNSAFGFQGRLLHLSAGQRLGVHLHTEARARHAWQLT<br>QGATVLGLFRVTPEIPAGLPSPRSEGGGGSGGGGSRTVAAP<br>SVFIFPPSDEQLKSGTASVVCLLNNFYPREAKVQWKVDNA<br>LQSGNSQESVTEQDSKDSTYSLSSTLTLSKADYEKHKVYA<br>CEVTHQGLSSPVTKSFNRGEC |
| 18 | anti-FAP(28H1) Fc hole chain | EVQLLESGGGLVQPGGSLRLSCAASGFTFSSHAMSWVRQA<br>PGKGLEWVSAIWASGEQYYADSVKGRFTISRDNSKNTLYL<br>QMNSLRAEDTAVYYCAKGWLGNFDYWGQGTLVTVSSAS<br>TKGPSVFPLAPSSKSTSGGTAALGCLVKDYFPEPVTVSWNS<br>GALTSGVHTFPAVLQSSGLYSLSSVVTVPSSSLGTQTYICN<br>VNHKPSNTKVDKKVEPKSCDKTHTCPPCPAPEAAGGPSVF |

TABLE 2-continued

Sequences of FAP-targeted human 4-1BB ligand trimer
containing Fc (kih) fusion molecule Construct 1.1

| SEQ ID NO: | Description | Sequence |
|---|---|---|
|  |  | LFPPKPKDTLMISRTPEVTCVVVDVSHEDPEVKFNWYVDG VEVHNAKTKPREEQYNSTYRVVSVLTVLHQDWLNGKEYK CKVSNKALGAPIEKTISKAKGQPREPQVCTLPPSRDELTKN QVSLSCAVKGFYPSDIAVEWESNGQPENNYKTTPPVLDSD GSFFLVSKLTVDKSRWQQGNVFSCSVMHEALHNHYTQKS LSLSPGK |
| 19 | anti-FAP (28H1) light chain | EIVLTQSPGTLSLSPGERATLSCRASQSVSRSYLAWYQQKP GQAPRLLIIGASTRATGIPDRFSGSGSGTDFTLTISRLEPEDF AVYYCQQGQVIPPTFGQGTKVEIKRTVAAPSVFIFPPSDEQ LKSGTASVVCLLNNFYPREAKVQWKVDNALQSGNSQESV TEQDSKDSTYSLSSTLTLSKADYEKHKVYACEVTHQGLSS PVTKSFNRGEC |

Table 3 shows the cDNA and amino acid sequences of acid sequences of the monovalent FAP-targeted 4-1BB ligand trimer-containing Fc (kih) fusion antigen binding molecule (FIG. 2B, Construct 1.2) with CH1-CL crossover and charged residues.

TABLE 3

Sequences of FAP-targeted human 4-1BB ligand trimer
containing Fc (kih) fusion molecule Construct 1.2

| SEQ ID NO: | Description | Sequence |
|---|---|---|
| 129 | Dimeric hu 4-1BBL (71-254)-CL* Fc knob chain | AGAGAGGGCCCTGAGCTGAGCCCCGATGATCCTGCTGG ACTGCTGGACCTGCGGCAGGGCATGTTTGCTCAGCTGGT GGCCCAGAACGTGCTGCTGATCGATGGCCCCCTGTCCTG GTACAGCGATCCTGGACTGGCTGGCGTGTCACTGACAGG CGGCCTGAGCTACAAAGAGGACACCAAAGAACTGGTGG TGGCCAAGGCCGGCGTGTACTACGTGTTCTTTCAGCTGG AACTGCGGAGAGTGGTGGCCGGCGAAGGATCTGGCTCT GTGTCTCTGGCCCTGCATCTGCAGCCTCTGAGAAGCGCT GCTGGCGCTGCAGCTCTGGCACTGACAGTGGATCTGCCT CCTGCCAGCTCCGAGGCCCGGAATAGCGCATTTGGGTTT CAAGGCAGGCTGCTGCACCTGTCTGCCGGCCAGAGGCT GGGAGTGCATCTGCACACAGAGGCCAGGGCTAGACACG CCTGGCAGCTGACACAGGGCGCTACAGTGCTGGGCCTG TTCAGAGTGACCCCCGAGATTCCAGCCGGCCTGCCTTCT CCAAGAAGCGAAGGCGGAGGCGGATCTGGCGGCGGAG GATCTAGAGAGGGACCCGAACTGTCCCCTGACGATCCA GCCGGGCTGCTGGATCTGAGACAGGGAATGTTCGCCCA GCTGGTGGCTCAGAATGTGCTGCTGATTGACGGACCTCT GAGCTGGTACTCCGACCCAGGGCTGGCAGGGGTGTCCC TGACTGGGGGACTGTCCTACAAAGAAGATACAAAAGAA CTGGTGGTGGCTAAAGCTGGGGTGTACTATGTGTTTTTT CAGCTGGAACTGAGGCGGGTGGTGGCTGGGGAGGGCTC AGGATCTGTGTCCCTGGCTCTGCATCTGCAGCCACTGCG CTCTGCTGCTGGCGCAGCTGCACTGGCTCTGACTGTGGA CCTGCCACCAGCCTCTAGCGAGGCCAGAAACAGCGCCT TCGGGTTCCAAGGACGCCTGCTGCATCTGAGCGCCGGAC AGCGCCTGGGAGTGCATCTGCATACTGAAGCCAGAGCC CGGCATGCTTGGCAGCTGACTCAGGGGGCAACTGTGCTG GGACTGTTTCGCGTGACACCTGAGATCCCTGCCGGACTG CCAAGCCCTAGATCAGAAGGGGGCGGAGGTTCCGGAGG GGGAGGATCTGTACGGTGGCTGCACCATCTGTCTTTAT CTTCCCACCCAGCGACCGGAAGCTGAAGTCTGGCACAG CCAGCGTCGTGTGCCTGCTGAATAACTTCTACCCCCGCG AGGCCAAGGTGCAGTGGAAGGTGGACAATGCCCTGCAG AGCGGCAACAGCCAGGAAAGCGTGACCGAGCAGGACA GCAAGGACTCCACCTACAGCCTGAGCAGCACCCTGACC CTGAGCAAGGCCGACTACGAGAAGCACAAGGTGTACGC CTGCGAAGTGACCCACCAGGGCCTGTCTAGCCCCGTGAC CAAGAGCTTCAACCGGGGCGAGTGCGACAAGACCCACA CCTGTCCTCCATGCCCTGCCCCTGAAGCTGCTGGCGGCC CTAGCGTGTTCCTGTTCCCCCAAAGCCCAAGGACACCC TGATGATCAGCCGGACCCCTGAAGTGACCTGCGTGGTGG TGGATGTGTCCCACGAGGACCCTGAAGTGAAGTTCAATT |

TABLE 3-continued

Sequences of FAP-targeted human 4-1BB ligand trimer containing Fc (kih) fusion molecule Construct 1.2

| SEQ ID NO: | Description | Sequence |
|---|---|---|
| | | GGTACGTGGACGGCGTGGAAGTGCACAATGCCAAGACC<br>AAGCCGCGGGAGGAGCAGTACAACAGCACGTACCGTGT<br>GGTCAGCGTCCTCACCGTCCTGCACCAGGACTGGCTGAA<br>TGGCAAGGAGTACAAGTGCAAGGTCTCCAACAAAGCCC<br>TCGGCGCCCCCATCGAGAAAACCATCTCCAAAGCCAAA<br>GGGCAGCCCCGAGAACCACAGGTGTACACCCTGCCCCC<br>ATGCCGGGATGAGCTGACCAAGAACCAGGTCAGCCTGT<br>GGTGCCTGGTCAAAGGCTTCTATCCCAGCGACATCGCCG<br>TGGAGTGGGAGAGCAATGGGCAGCCGGAGAACAACTAC<br>AAGACCACGCCTCCCGTGCTGGACTCCGACGGCTCCTTC<br>TTCCTCTACAGCAAGCTCACCGTGGACAAGAGCAGGTG<br>GCAGCAGGGGAACGTCTTCTCATGCTCCGTGATGCATGA<br>GGCTCTGCACAACCACTACACGCAGAAGAGCCTCTCCCT<br>GTCTCCGGGTAAA |
| 130 | Monomeric hu 4-1BBL (71-254)-CH1* | AGAGAGGGCCCTGAGCTGAGCCCCGATGATCCTGCTGG<br>ACTGCTGGACCTGCGGCAGGGCATGTTTGCTCAGCTGGT<br>GGCCCAGAACGTGCTGCTGATCGATGGCCCCCTGTCCTG<br>GTACAGCGATCCTGGACTGGCTGGCGTGTCACTGACAGG<br>CGGCCTGAGCTACAAAGAGGACACCAAAGAACTGGTGG<br>TGGCCAAGGCCGGCGTGTACTACGTGTTCTTTCAGCTGG<br>AACTGCGGAGAGTGGTGGCCGGCGAAGGATCTGGCTCT<br>GTGTCTCTGGCCCTGCATCTGCAGCCTCTGAGAAGCGCT<br>GCTGGCGCTGCAGCTCTGGCTCTGACAGTGGATCTGCCT<br>CCTGCCAGCTCCGAGGCCCGGAATAGCGCATTTGGGTTT<br>CAAGGCCGGCTGCTGCACCTGTCTGCCGGCCAGAGACT<br>GGGAGTGCATCTGCACACAGAGGCCAGAGCCAGGCACG<br>CCTGGCAGCTGACACAGGGCGCTACAGTGCTGGGCCTG<br>TTCAGAGTGACCCCCGAGATTCCTGCCGGCCTGCCTAGC<br>CCTAGATCTGAAGGCGGCGGAGGTTCCGGAGGCGGAGG<br>ATCTGCTAGCACAAAGGGCCCCAGCGTGTTCCCTCTGGC<br>CCCTAGCAGCAAGAGCACATCTGGCGGAACAGCCGCCC<br>TGGGCTGCCTGGTGGAAGATTACTTCCCCGAGCCCGTGA<br>CCGTGTCCTGGAATTCTGGCGCCCTGACAAGCGGCGTGC<br>ACACCTTTCCAGCCGTGCTGCAGAGCAGCGGCCTGTACT<br>CTCTGAGCAGCGTCGTGACAGTGCCCAGCAGCTCTCTGG<br>GCACCCAGACCTACATCTGCAACGTGAACCACAAGCCC<br>AGCAACACCAAGGTGGACGAGAAGGTGGAACCCAAGTC<br>CTGC |
| 68 | anti-FAP Fc hole chain | See Table 2 |
| 69 | anti-FAP light chain | See Table 2 |
| 115 | Dimeric hu 4-1BBL (71-254)-CL* Fc knob chain | REGPELSPDDPAGLLDLRQGMFAQLVAQNVLLIDGPLSWY<br>SDPGLAGVSLTGGLSYKEDTKELVVAKAGVYYVFFQLELR<br>RVVAGEGSGSVSLALHLQPLRSAAGAAALALTVDLPPASS<br>EARNSAFGFQGRLLHLSAGQRLGVHLHTEARARHAWQLT<br>QGATVLGLFRVTPEIPAGLPSPRSEGGGGSGGGGSREGPEL<br>SPDDPAGLLDLRQGMFAQLVAQNVLLIDGPLSWYSDPGLA<br>GVSLTGGLSYKEDTKELVVAKAGVYYVFFQLELRRVVAG<br>EGSGSVSLALHLQPLRSAAGAAALALTVDLPPASSEARNS<br>AFGFQGRLLHLSAGQRLGVHLHTEARARHAWQLTQGATV<br>LGLFRVTPEIPAGLPSPRSEGGGGSGGGGSRTVAAP SVFIFP<br>PSDRKLKSGTASVVCLLNNFYPREAKVQWKVDNALQSGN<br>SQESVTEQDSKDSTYSLSSTLTLSKADYEKHKVYACEVTH<br>QGLSSPVTKSFNRGECDKTHTCPPCPAPEAAGGPSVFLFPP<br>KPKDTLMISRTPEVTCVVVDVSHEDPEVKFNWYVDGVEV<br>HNAKTKPREEQYNSTYRVVSVLTVLHQDWLNGKEYKCKV<br>SNKALGAPIEKTISKAKGQPREPQVYTLPPCRDELTKNQVS<br>LWCLVKGFYPSDIAVEWESNGQPENNYKTTPPVLDSDGSF<br>FLYSKLTVDKSRWQQGNVFSCSVMHEALHNHYTQKSLSL<br>SPGK |
| 116 | Monomeric hu 4-1BBL (71-254)-CH1* | REGPELSPDDPAGLLDLRQGMFAQLVAQNVLLIDGPLSWY<br>SDPGLAGVSLTGGLSYKEDTKELVVAKAGVYYVFFQLELR<br>RVVAGEGSGSVSLALHLQPLRSAAGAAALALTVDLPPASS<br>EARNSAFGFQGRLLHLSAGQRLGVHLHTEARARHAWQLT<br>QGATVLGLFRVTPEIPAGLPSPRSEGGGGSGGGGSASTKGP<br>SVFPLAPSSKSTSGGTAALGCLVEDYFPEPVTVSWNSGALT<br>SGVHTFPAVLQSSGLYSLSSVVTVPSSSLGTQTYICNVNHK<br>PSNTKVDEKVEPKSC |

TABLE 3-continued

Sequences of FAP-targeted human 4-1BB ligand trimer containing Fc (kih) fusion molecule Construct 1.2

| SEQ ID NO: | Description | Sequence |
|---|---|---|
| 18 | anti-FAP(28H1) Fc hole chain | See Table 2 |
| 19 | anti-FAP (28H1) light chain | See Table 2 |

Table 4 shows the cDNA and amino acid sequences of the monovalent FAP-targeted 4-1BB ligand trimer-containing Fc (kih) fusion molecule Construct 1.3 (FIG. 2C) (FAP split trimer with CH1-CL crossover in anti-FAP Fab and charged residues on the 4-1BBL containing chains).

TABLE 4

Sequences of FAP-targeted human 4-1BB ligand trimer containing Fc (kih) fusion molecule Construct 1.3

| SEQ ID NO: | Description | Sequence |
|---|---|---|
| 131 | Dimeric hu 4-1BBL (71-254)-CH1* Fc knob chain | AGAGAGGGCCCTGAGCTGAGCCCCGATGATCCTGCTGG<br>ACTGCTGGACCTGCGGCAGGGCATGTTTGCTCAGCTGGT<br>GGCCCAGAACGTGCTGCTGATCGATGGCCCCCTGTCCTG<br>GTACAGCGATCCTGGACTGGCTGGCGTGTCACTGACAGG<br>CGGCCTGAGCTACAAAGAGGACACCAAAGAACTGGTGG<br>TGGCCAAGGCCGGCGTGTACTACGTGTTCTTTCAGCTGG<br>AACTGCGGAGAGTGGTGGCCGGCGAAGGATCTGGCTCT<br>GTGTCTCTGGCCCTGCATCTGCAGCCTCTGAGAAGCGCT<br>GCTGGCGCTGCAGCTCTGGCACTGACAGTGGATCTGCCT<br>CCTGCCAGCTCCGAGGCCCGGAATAGCGCATTTGGGTTT<br>CAAGGCAGGCTGCTGCACCTGTCTGCCGGCCAGAGGCT<br>GGGAGTGCATCTGCACACAGAGGCCAGGGCTAGACACG<br>CCTGGCAGCTGACACAGGGCGCTACAGTGCTGGGCCTG<br>TTCAGAGTGACCCCCGAGATTCCAGCCGGCCTGCCTTCT<br>CCAAGAAGCGAAGGCGGAGGCGGATCTGGCGGCGGAG<br>GATCTAGAGAGGGACCCGAACTGTCCCCTGACGATCCA<br>GCCGGGCTGCTGGATCTGAGACAGGGAATGTTCGCCCA<br>GCTGGTGGCTCAGAATGTGCTGCTGATTGACGGACCTCT<br>GAGCTGGTACTCCGACCCAGGGCTGGCAGGGGTGTCCC<br>TGACTGGGGGACTGTCCTACAAAGAAGATACAAAAGAA<br>CTGGTGGTGGCTAAAGCTGGGGTGTACTATGTGTTTTTT<br>CAGCTGGAACTGAGGCGGGTGGTGGCTGGGGAGGGCTC<br>AGGATCTGTGTCCCTGGCTCTGCATCTGCAGCCACTGCG<br>CTCTGCTGCTGGCGCAGCTGCACTGGCTCTGACTGTGGA<br>CCTGCCACCAGCCTCTAGCGAGGCCAGAAACAGCGCCT<br>TCGGGTTCCAAGGACGCCTGCTGCATCTGAGCGCCGGAC<br>AGCGCCTGGGAGTGCATCTGCATACTGAAGCCAGAGCC<br>CGGCATGCTTGGCAGCTGACTCAGGGGGCAACTGTGCTG<br>GGACTGTTTCGCGTGACACCTGAGATCCCTGCCGGACTG<br>CCAAGCCCTAGATCAGAAGGGGGCGGAGGAAGCGGAG<br>GGGGAGGAAGTGCTAGCACCAAGGGCCCCTCCGTGTTC<br>CCCCTGGCCCCCAGCAGCAAGAGCACCAGCGGCGGCAC<br>AGCCGCTCTGGGCTGCCTGGTCGAGGACTACTTCCCCGA<br>GCCCGTGACCGTGTCCTGGAACAGCGGAGCCCTGACCTC<br>CGGCGTGCACACCTTCCCCGCCGTGCTGCAGAGTTCTGG<br>CCTGTATAGCCTGAGCAGCGTGGTCACCGTGCCTTCTAG<br>CAGCCTGGGCACCCAGACCTACATCTGCAACGTGAACC<br>ACAAGCCCAGCAACACCAAGGTGGACGAGAAGGTGGA<br>GCCCAAGAGCTGCGACAAAACTCACACATGCCCACCGT<br>GCCCAGCACCTGAAGCTGCAGGGGGACCGTCAGTCTTC<br>CTCTTCCCCCCAAAACCCAAGGACACCCTCATGATCTCC<br>CGGACCCCTGAGGTCACATGCGTGGTGGTGGACGTGAG<br>CCACGAAGACCCTGAGGTCAAGTTCAACTGGTACGTGG<br>ACGGCGTGGAGGTGCATAATGCCAAGACAAAGCCGCGG<br>GAGGAGCAGTACAACAGCACGTACCGTGTGGTCAGCGT<br>CCTCACCGTCCTGCACCAGGACTGGCTGAATGGCAAGG<br>AGTACAAGTGCAAGGTCTCCAACAAAGCCCTCGGCGCC<br>CCCATCGAGAAAACCATCTCCAAAGCCAAAGGGCAGCC<br>CCGAGAACCACAGGTGTACACCCTGCCCCCATGCCGGG<br>ATGAGCTGACCAAGAACCAGGTCAGCCTGTGGTGCCTG |

TABLE 4-continued

Sequences of FAP-targeted human 4-1BB ligand trimer containing Fc (kih) fusion molecule Construct 1.3

| SEQ ID NO: | Description | Sequence |
|---|---|---|
| | | GTCAAAGGCTTCTATCCCAGCGACATCGCCGTGGAGTGG<br>GAGAGCAATGGGCAGCCGGAGAACAACTACAAGACCAC<br>GCCTCCCGTGCTGGACTCCGACGGCTCCTTCTTCCTCTAC<br>AGCAAGCTCACCGTGGACAAGAGCAGGTGGCAGCAGGG<br>GAACGTCTTCTCATGCTCCGTGATGCATGAGGCTCTGCA<br>CAACCACTACACGCAGAAGAGCCTCTCCCTGTCTCCGGG<br>TAAA |
| 132 | Monomeric hu 4-1BBL (71-254)-CL* | AGAGAGGGCCCTGAGCTGAGCCCCGATGATCCTGCTGG<br>ACTGCTGGACCTGCGGCAGGGCATGTTTGCTCAGCTGGT<br>GGCCCAGAACGTGCTGCTGATCGATGGCCCCCTGTCCTG<br>GTACAGCGATCCTGGACTGGCTGGCGTGTCACTGACAGG<br>CGGCCTGAGCTACAAAGAGGACACCAAAGAACTGGTGG<br>TGGCCAAGGCCGGCGTGTACTACGTGTTCTTTCAGCTGG<br>AACTGCGGAGAGTGGTGGCCGGCGAAGGATCTGGCTCT<br>GTGTCTCTGGCCCTGCATCTGCAGCCTCTGAGAAGCGCT<br>GCTGGCGCTGCAGCTCTGGCACTGACAGTGGATCTGCCT<br>CCTGCCAGCTCCGAGGCCCGGAATAGCGCATTTGGGTTT<br>CAAGGCAGGCTGCTGCACCTGTCTGCCGGCCAGAGGCT<br>GGGAGTGCATCTGCACACAGAGGCCAGGGCTAGACACG<br>CCTGGCAGCTGACACAGGGCGCTACAGTGCTGGGCCTG<br>TTCAGAGTGACCCCCGAGATTCCAGCCGGCCTGCCTTCT<br>CCAAGAAGCGAAGGCGGAGGCGGATCTGGCGGCGGAG<br>GATCTCGTACGGTGGCTGCACCATCTGTCTTCATCTTCCC<br>GCCATCTGATCGGAAGTTGAAATCTGGAACTGCCTCTGT<br>TGTGTGCCTGCTGAATAACTTCTATCCCAGAGAGGCCAA<br>AGTACAGTGGAAGGTGGATAACGCCCTCCAATCGGGTA<br>ACTCCCAGGAGAGTGTCACAGAGCAGGACAGCAAGGAC<br>AGCACCTACAGCCTCAGCAGCACCCTGACGCTGAGCAA<br>AGCAGACTACGAGAAACACAAAGTCTACGCCTGCGAAG<br>TCACCCATCAGGGCCTGAGCTCGCCCGTCACAAAGAGCT<br>TCAACAGGGGAGAGTGT |
| 133 | anti-FAP (VHCL) (28H1) Fc hole chain | GAAGTGCAGCTGCTGGAATCCGGCGGAGGCCTGGTGCA<br>GCCTGGCGGATCTCTGAGACTGTCCTGCGCCGCCTCCGG<br>CTTCACCTTCTCCTCCCACGCCATGTCCTGGGTCCGACA<br>GGCTCCTGGCAAAGGCCTGGAATGGGTGTCCGCCATCTG<br>GGCCTCCGGCGAGCAGTACTACGCCGACTCTGTGAAGG<br>GCCGGTTCACCATCTCCCGGGACAACTCCAAGAACACCC<br>TGTACCTGCAGATGAACTCCCTGCGGGCCGAGGACACC<br>GCCGTGTACTACTGTGCCAAGGGCTGGCTGGGCAACTTC<br>GACTACTGGGGACAGGGCACCCTGGTCACCGTGTCCAG<br>CGCTAGCGTGGCCGCTCCCAGCGTGTTCATCTTCCCACC<br>CAGCGACGAGCAGCTGAAGTCCGGCACAGCCAGCGTGG<br>TGTGCCTGCTGAACAACTTCTACCCCCGCGAGGCCAAGG<br>TGCAGTGGAAGGTGGACAACGCCCTGCAGAGCGGCAAC<br>AGCCAGGAATCCGTGACCGAGCAGGACAGCAAGGACTC<br>CACCTACAGCCTGAGCAGCACCCTGACCCTGAGCAAGG<br>CCGACTACGAGAAGCACAAGGTGTACGCCTGCGAAGTG<br>ACCCACCAGGGCCTGTCCAGCCCCGTGACCAAGAGCTTC<br>AACCGGGGCGAGTGCGACAAGACCCACACCTGTCCCCC<br>TTGCCCTGCCCCTGAAGCTGCTGGTGGCCCTTCCGTGTT<br>CCTGTTCCCCCCAAAGCCCAAGGACACCCTGATGATCAG<br>CCGGACCCCCGAAGTGACCTGCGTGGTGGTCGATGTGTC<br>CCACGAGGACCCTGAAGTGAAGTTCAATTGGTACGTGG<br>ACGGCGTGGAAGTGCACAATGCCAAGACCAAGCCGCGG<br>GAGGAGCAGTACAACAGCACGTACCGTGTGGTCAGCGT<br>CCTCACCGTCCTGCACCAGGACTGGCTGAATGGCAAGG<br>AGTACAAGTGCAAGGTCTCCAACAAAGCCCTCGGCGCC<br>CCCATCGAGAAAACCATCTCCAAAGCCAAAGGGCAGCC<br>CCGAGAACCACAGGTGTGCACCCTGCCCCCATCCCGGG<br>ATGAGCTGACCAAGAACCAGGTCAGCCTCTCGTGCGCA<br>GTCAAAGGCTTCTATCCCAGCGACATCGCCGTGGAGTGG<br>GAGAGCAATGGGCAGCCGGAGAACAACTACAAGACCAC<br>GCCTCCCGTGCTGGACTCCGACGGCTCCTTCTTCCTCGT<br>GAGCAAGCTCACCGTGGACAAGAGCAGGTGGCAGCAGG<br>GGAACGTCTTCTCATGCTCCGTGATGCATGAGGCTCTGC<br>ACAACCACTACACGCAGAAGAGCCTCTCCCTGTCTCCGG<br>GTAAA |
| 134 | anti-FAP (VLCH1) (28H1) light chain | GAGATCGTGCTGACCCAGTCTCCCGGCACCCTGAGCCTG<br>AGCCCTGGCGAGAGAGCCACCCTGAGCTGCAGAGCCAG<br>CCAGAGCGTGAGCCGGAGCTACCTGGCCTGGTATCAGC<br>AGAAGCCCGGCCAGGCCCCCAGACTGCTGATCATCGGC |

TABLE 4-continued

Sequences of FAP-targeted human 4-1BB ligand trimer
containing Fc (kih) fusion molecule Construct 1.3

| SEQ ID NO: | Description | Sequence |
|---|---|---|
|  |  | GCCAGCACCCGGGCCACCGGCATCCCCGATAGATTCAG CGGCAGCGGCTCCGGCACCGACTTCACCCTGACCATCAG CCGGCTGGAACCCGAGGACTTCGCCGTGTACTACTGCCA GCAGGGCCAGGTGATCCCCCCCACCTTCGGCCAGGGCA CCAAGGTGGAAATCAAGAGCAGCGCTTCCACCAAAGGC CCTTCCGTGTTTCCTCTGGCTCCTAGCTCCAAGTCCACCT CTGGAGGCACCGCTGCTCTCGGATGCCTCGTGAAGGATT ATTTTCCTGAGCCTGTGACAGTGTCCTGGAATAGCGGAG CACTGACCTCTGGAGTGCATACTTTCCCCGCTGTGCTGC AGTCCTCTGGACTGTACAGCCTGAGCAGCGTGGTGACAG TGCCCAGCAGCAGCCTGGGCACCCAGACCTACATCTGC AACGTGAACCACAAGCCCAGCAACACCAAGGTGGACAA GAAGGTGGAACCCAAGTCTTGT |
| 108 | Dimeric hu 4-1BBL (71-254)-CH1* Fc knob chain | REGPELSPDDPAGLLDLRQGMFAQLVAQNVLLIDGPLSWY SDPGLAGVSLTGGLSYKEDTKELVVAKAGVYYVFFQLELR RVVAGEGSGSVSLALHLQPLRSAAGAAALALTVDLPPASS EARNSAFGFQGRLLHLSAGQRLGVHLHTEARARHAWQLT QGATVLGLFRVTPEIPAGLPSPRSEGGGGSGGGGSREGPEL SPDDPAGLLDLRQGMFAQLVAQNVLLIDGPLSWYSDPGLA GVSLTGGLSYKEDTKELVVAKAGVYYVFFQLELRRVVAG EGSGSVSLALHLQPLRSAAGAAALALTVDLPPASSEARNS AFGFQGRLLHLSAGQRLGVHLHTEARARHAWQLTQGATV LGLFRVTPEIPAGLPSPRSEGGGGSGGGGSASTKGPSVFPLA PSSKSTSGGTAALGCLVEDYFPEPVTVSWNSGALTSGVHTF PAVLQSSGLYSLSSVVTVPSSSLGTQTYICNVNHKPSNTKV DEKVEPKSCDKTHTCPPCPAPEAAGGPSVFLFPPKPKDTLM ISRTPEVTCVVVDVSHEDPEVKFNWYVDGVEVHNAKTKP REEQYNSTYRVVSVLTVLHQDWLNGKEYKCKVSNKALGA PIEKTISKAKGQPREPQVYTLPPCRDELTKNQVSLWCLVKG FYPSDIAVEWESNGQPENNYKTTPPVLDSDGSFFLYSKLTV DKSRWQQGNVFSCSVMHEALHNHYTQKSLSLSPGK |
| 109 | Monomeric hu 4-1BBL (71-254)-CL* | REGPELSPDDPAGLLDLRQGMFAQLVAQNVLLIDGPLSWY SDPGLAGVSLTGGLSYKEDTKELVVAKAGVYYVFFQLELR RVVAGEGSGSVSLALHLQPLRSAAGAAALALTVDLPPASS EARNSAFGFQGRLLHLSAGQRLGVHLHTEARARHAWQLT QGATVLGLFRVTPEIPAGLPSPRSEGGGGSGGGGSRTVAAP SVFIFPPSDRKLKSGTASVVCLLNNFYPREAKVQWKVDNA LQSGNSQESVTEQDSKDSTYSLSSTLTLSKADYEKHKVYA CEVTHQGLSSPVTKSFNRGEC |
| 135 | anti-FAP (VHCL) (28H1) Fc hole chain | EVQLLESGGGLVQPGGSLRLSCAASGFTFSSHAMSWVRQA PGKGLEWVSAIWASGEQYYADSVKGRFTISRDNSKNTLYL QMNSLRAEDTAVYYCAKGWLGNFDYWGQGTLVTVSSAS VAAPSVFIFPPSDEQLKSGTASVVCLLNNFYPREAKVQWK VDNALQSGNSQESVTEQDSKDSTYSLSSTLTLSKADYEKH KVYACEVTHQGLSSPVTKSFNRGECDKTHTCPPCPAPEAA GGPSVFLFPPKPKDTLMISRTPEVTCVVVDVSHEDPEVKFN WYVDGVEVHNAKTKPREEQYNSTYRVVSVLTVLHQDWL NGKEYKCKVSNKALGAPIEKTISKAKGQPREPQVCTLPPSR DELTKNQVSLSCAVKGFYPSDIAVEWESNGQPENNYKTTP PVLDSDGSFFLVSKLTVDKSRWQQGNVFSCSVMHEALHN HYTQKSLSLSPGK |
| 136 | anti-FAP (VLCH1) (28H1) light chain | EIVLTQSPGTLSLSPGERATLSCRASQSVSRSYLAWYQQKP GQAPRLLIIGASTRATGIPDRFSGSGSGTDFTLTISRLEPEDF AVYYCQQGQVIPPTFGQGTKVEIKSSASTKGPSVFPLAPSS KSTSGGTAALGCLVKDYFPEPVTVSWNSGALTSGVHTFPA VLQSSGLYSLSSVVTVPSSSLGTQTYICNVNHKPSNTKVDK KVEPKSC |

Table 5 shows the cDNA and amino acid sequences of the monovalent FAP-targeted 4-1BB ligand trimer-containing Fc (kih) fusion molecule Construct 1.4 (FIG. 2D) (FAP split trimer with anti-FAP Fab, monomeric 4-1BB ligand fused to CH1-knob chain and charged residues on the 4-1BBL containing chains).

TABLE 5

Sequences of FAP-targeted human 4-1BB ligand trimer containing Fc (kih) fusion molecule Construct 1.4

| SEQ ID NO: | Description | Sequence |
|---|---|---|
| 137 | Monomeric hu 4-1BBL (71-254)-CH1* Fc knob chain | AGAGAGGGCCCTGAGCTGAGCCCCGATGATCCTGCTGG ACTGCTGGACCTGCGGCAGGGCATGTTTGCTCAGCTGGT GGCCCAGAACGTGCTGCTGATCGATGGCCCCCTGTCCTG GTACAGCGATCCTGGACTGGCTGGCGTGTCACTGACAGG CGGCCTGAGCTACAAAGAGGACACCAAAGAACTGGTGG TGGCCAAGGCCGGCGTGTACTACGTGTTCTTTCAGCTGG AACTGCGGAGAGTGGTGGCCGGCGAAGGATCTGGCTCT GTGTCTCTGGCCCTGCATCTGCAGCCTCTGAGAAGCGCT GCTGGCGCTGCAGCTCTGGCTCTGACAGTGGATCTGCCT CCTGCCAGCTCCGAGGCCCGGAATAGCGCATTTGGGTTT CAAGGCCGGCTGCTGCACCTGTCTGCCGGCCAGAGACT GGGAGTGCATCTGCACACAGAGGCCAGAGCCAGGCACG CCTGGCAGCTGACACAGGGCGCTACAGTGCTGGGCCTG TTCAGAGTGACCCCCGAGATTCCTGCCGGCCTGCCTAGC CCTAGATCTGAAGGCGGCGGAGGTTCCGGAGGCGGAGG ATCTGCTAGCACCAAGGGCCCCTCCGTGTTCCCCCTGGC CCCCAGCAGCAAGAGCACCAGCGGCGGCACAGCCGCTC TGGGCTGCCTGGTCGAGGACTACTTCCCCGAGCCCGTGA CCGTGTCCTGGAACAGCGGAGCCCTGACCTCCGGCGTGC ACACCTTCCCCGCCGTGCTGCAGAGTTCTGGCCTGTATA GCCTGAGCAGCGTGGTCACCGTGCCTTCTAGCAGCCTGG GCACCCAGACCTACATCTGCAACGTGAACCACAAGCCC AGCAACACCAAGGTGGACGAGAAGGTGGAGCCCAAGA GCTGCGACAAAACTCACACATGCCCACCGTGCCCAGCA CCTGAAGCTGCAGGGGGACCGTCAGTCTTCCTCTTCCCC CCAAAACCCAAGGACACCCTCATGATCTCCCGGACCCCT GAGGTCACATGCGTGGTGGTGGACGTGAGCCACGAAGA CCCTGAGGTCAAGTTCAACTGGTACGTGGACGGCGTGG AGGTGCATAATGCCAAGACAAAGCCGCGGGAGGAGCAG TACAACAGCACGTACCGTGTGGTCAGCGTCCTCACCGTC CTGCACCAGGACTGGCTGAATGGCAAGGAGTACAAGTG CAAGGTCTCCAACAAAGCCCTCGGCGCCCCCATCGAGA AAACCATCTCCAAAGCCAAAGGGCAGCCCCGAGAACCA CAGGTGTACACCCTGCCCCCATGCCGGGATGAGCTGACC AAGAACCAGGTCAGCCTGTGGTGCCTGGTCAAAGGCTTC TATCCCAGCGACATCGCCGTGGAGTGGGAGAGCAATGG GCAGCCGGAGAACAACTACAAGACCACGCCTCCCGTGC TGGACTCCGACGGCTCCTTCTTCCTCTACAGCAAGCTCA CCGTGGACAAGAGCAGGTGGCAGCAGGGGAACGTCTTC TCATGCTCCGTGATGCATGAGGCTCTGCACAACCACTAC ACGCAGAAGAGCCTCTCCCTGTCTCCGGGTAAA |
| 138 | Dimeric hu 4-1BBL (71-254)-CL* | AGAGAGGGCCCTGAGCTGAGCCCCGATGATCCTGCTGG ACTGCTGGACCTGCGGCAGGGCATGTTTGCTCAGCTGGT GGCCCAGAACGTGCTGCTGATCGATGGCCCCCTGTCCTG GTACAGCGATCCTGGACTGGCTGGCGTGTCACTGACAGG CGGCCTGAGCTACAAAGAGGACACCAAAGAACTGGTGG TGGCCAAGGCCGGCGTGTACTACGTGTTCTTTCAGCTGG AACTGCGGAGAGTGGTGGCCGGCGAAGGATCTGGCTCT GTGTCTCTGGCCCTGCATCTGCAGCCTCTGAGAAGCGCT GCTGGCGCTGCAGCTCTGGCACTGACAGTGGATCTGCCT CCTGCCAGCTCCGAGGCCCGGAATAGCGCATTTGGGTTT CAAGGCAGGCTGCTGCACCTGTCTGCCGGCCAGAGGCT GGGAGTGCATCTGCACACAGAGGCCAGGGCTAGACACG CCTGGCAGCTGACACAGGGCGCTACAGTGCTGGGCCTG TTCAGAGTGACCCCCGAGATTCCAGCCGGCCTGCCTTCT CCAAGAAGCGAAGGCGGAGGCGGATCTGGCGGCGGAG GATCTAGAGAGGGACCCGAACTGTCCCCTGACGATCCA GCCGGGCTGCTGGATCTGAGACAGGGAATGTTCGCCCA GCTGGTGGCTCAGAATGTGCTGCTGATTGACGGACCTCT GAGCTGGTACTCCGACCCAGGGCTGGCAGGGGTGTCCC TGACTGGGGGACTGTCCTACAAAGAAGATACAAAAGAA CTGGTGGTGGCTAAAGCTGGGGTGTACTATGTGTTTTTT CAGCTGGAACTGAGGCGGGTGGTGGCTGGGGAGGGCTC AGGATCTGTGTCCCTGGCTCTGCATCTGCAGCCACTGCG CTCTGCTGCTGGCGCAGCTGCACTGGCTCTGACTGTGGA CCTGCCACCAGCCTCTAGCGAGGCAGAAACAGCGCCT TCGGGTTCCAAGGACGCCTGCTGCATCTGAGCGCCGGAC AGCGCCTGGGAGTGCATCTGCATACTGAAGCCAGAGCC CGGCATGCTTGGCAGCTGACTCAGGGGGCAACTGTGCTG GGACTGTTTCGCGTGACACCTGAGATCCCTGCCGGACTG CCAAGCCCTAGATCAGAAGGGGGCGGAGGTTCCGGAGG GGAGGGATCTCGTACGGTGGCTGCACCATCTGTCTTCAT CTTCCCGCCATCTGATCGGAAGTTGAAATCTGGAACTGC |

TABLE 5-continued

Sequences of FAP-targeted human 4-1BB ligand trimer containing
Fc (kih) fusion molecule Construct 1.4

| SEQ ID NO: | Description | Sequence |
|---|---|---|
| | | CTCTGTTGTGTGCCTGCTGAATAACTTCTATCCCAGAGA<br>GGCCAAAGTACAGTGGAAGGTGGATAACGCCCTCCAAT<br>CGGGTAACTCCCAGGAGAGTGTCACAGAGCAGGACAGC<br>AAGGACAGCACCTACAGCCTCAGCAGCACCCTGACGCT<br>GAGCAAAGCAGACTACGAGAAACACAAAGTCTACGCCT<br>GCGAAGTCACCCATCAGGGCCTGAGCTCGCCCGTCACA<br>AAGAGCTTCAACAGGGGAGAGTGT |
| 68 | anti-FAP (28H1) Fc hole chain | see Table 2 |
| 69 | anti-FAP (28H1) light chain | See Table 2 |
| 139 | Monomeric hu 4-1BBL (71-254)-CL* Fc knob chain | REGPELSPDDPAGLLDLRQGMFAQLVAQNVLLIDGPLSWY<br>SDPGLAGVSLTGGLSYKEDTKELVVAKAGVYYVFFQLELR<br>RVVAGEGSGSVSLALHLQPLRSAAGAAALALTVDLPPASS<br>EARNSAFGFQGRLLHLSAGQRLGVHLHTEARARHAWQLT<br>QGATVLGLFRVTPEIPAGLPSPRSEGGGGSGGGGSREGPEL<br>SPDDPAGLLDLRQGMFAQLVAQNVLLIDGPLSWYSDPGLA<br>GVSLTGGLSYKEDTKELVVAKAGVYYVFFQLELRRVVAG<br>EGSGSVSLALHLQPLRSAAGAAALALTVDLPPASSEARNS<br>AFGFQGRLLHLSAGQRLGVHLHTEARARHAWQLTQGATV<br>LGLFRVTPEIPAGLPSPRSEGGGGSGGGGSASTKGPSVFPLA<br>PSSKSTSGGTAALGCLVEDYFPEPVTVSWNSGALTSGVHTF<br>PAVLQSSGLYSLSSVVTVPSSSLGTQTYICNVNHKPSNTKV<br>DEKVEPKSCDKTHTCPPCPAPEAAGGPSVFLFPPKPKDTLM<br>ISRTPEVTCVVVDVSHEDPEVKFNWYVDGVEVHNAKTKP<br>REEQYNSTYRVVSVLTVLHQDWLNGKEYKCKVSNKALGA<br>PIEKTISKAKGQPREPQVYTLPPCRDELTKNQVSLWCLVKG<br>FYPSDIAVEWESNGQPENNYKTTPPVLDSDGSFFLYSKLTV<br>DKSRWQQGNVFSCSVMHEALHNHYTQKSLSLSPGK |
| 140 | Dimeric hu 4-1BBL (71-254)-CL* | REGPELSPDDPAGLLDLRQGMFAQLVAQNVLLIDGPLSWY<br>SDPGLAGVSLTGGLSYKEDTKELVVAKAGVYYVFFQLELR<br>RVVAGEGSGSVSLALHLQPLRSAAGAAALALTVDLPPASS<br>EARNSAFGFQGRLLHLSAGQRLGVHLHTEARARHAWQLT<br>QGATVLGLFRVTPEIPAGLPSPRSEGGGGSGGGGSREGPEL<br>SPDDPAGLLDLRQGMFAQLVAQNVLLIDGPLSWYSDPGLA<br>GVSLTGGLSYKEDTKELVVAKAGVYYVFFQLELRRVVAG<br>EGSGSVSLALHLQPLRSAAGAAALALTVDLPPASSEARNS<br>AFGFQGRLLHLSAGQRLGVHLHTEARARHAWQLTQGATV<br>LGLFRVTPEIPAGLPSPRSEGGGGSGGGGSRTVAAPSVFIFP<br>PSDRKLKSGTASVVCLLNNFYPREAKVQWKVDNALQSGN<br>SQESVTEQDSKDSTYSLSSTLTLSKADYEKHKVYACEVTH<br>QGLSSPVTKSFNRGEC |
| 18 | anti-FAP (28H1) Fc hole chain | see Table 2 |
| 19 | anti-FAP (28H1) light chain | see Table 2 |

Table 6 shows the cDNA and amino acid sequences of the bivalent FAP-targeted 4-1BB ligand trimer-containing Fc (kih) fusion molecule Construct 1.5 (FIG. 2E) (FAP split trimer with 2 anti-FAP Fabs, dimeric and monomeric 4-1BB ligand fused at the C-terminus of each heavy chain, respectively).

TABLE 6

Sequences of FAP-targeted human 4-1BB ligand trimer containing
Fc (kih) fusion molecule Construct 1.5

| SEQ ID NO: | Description | Sequence |
|---|---|---|
| 141 | anti-FAP (28H1) Fc hole chain fused to dimeric hu 4-1BBL (71-254) | GAAGTGCAGCTGCTGGAATCCGGCGGAGGCCTGGTGCA<br>GCCTGGCGGATCTCTGAGACTGTCCTGCGCCGCCTCCGG<br>CTTCACCTTCTCCTCCCACGCCATGTCCTGGGTCCGACA<br>GGCTCCTGGCAAAGGCCTGGAATGGGTGTCCGCCATCTG<br>GGCCTCCGGCGAGCAGTACTACGCCGACTCTGTGAAGG<br>GCCGGTTCACCATCTCCCGGGACAACTCCAAGAACACCC |

TABLE 6-continued

Sequences of FAP-targeted human 4-1BB ligand trimer containing Fc (kih) fusion molecule Construct 1.5

| SEQ ID NO: | Description | Sequence |
|---|---|---|
| | | TGTACCTGCAGATGAACTCCCTGCGGGCCGAGGACACC GCCGTGTACTACTGTGCCAAGGGCTGGCTGGGCAACTTC GACTACTGGGGACAGGGCACCCTGGTCACCGTGTCCAG CGCTAGCACCAAGGGCCCCTCCGTGTTCCCCCTGGCCCC CAGCAGCAAGAGCACCAGCGGCGGCACAGCCGCTCTGG GCTGCCTGGTCAAGGACTACTTCCCCGAGCCCGTGACCG TGTCCTGGAACAGCGGAGCCCTGACCTCCGGCGTGCAC ACCTTCCCCGCCGTGCTGCAGAGTTCTGGCCTGTATAGC CTGAGCAGCGTGGTCACCGTGCCTTCTAGCAGCCTGGGC ACCCAGACCTACATCTGCAACGTGAACCACAAGCCCAG CAACACCAAGGTGGACAAGAAGGTGGAGCCCAAGAGCT GCGACAAAACTCACACATGCCCACCGTGCCCAGCACCT GAAGCTGCAGGGGACCGTCAGTCTTCCTCTTCCCCCCA AAACCCAAGGACACCCTCATGATCTCCCGGACCCCTGA GGTCACATGCGTGGTGGTGGACGTGAGCCACGAAGACC CTGAGGTCAAGTTCAACTGGTACGTGGACGGCGTGGAG GTGCATAATGCCAAGACAAAGCCGCGGGAGGAGCAGTA CAACAGCACGTACCGTGTGGTCAGCGTCCTCACCGTCCT GCACCAGGACTGGCTGAATGGCAAGGAGTACAAGTGCA AGGTCTCCAACAAAGCCCTCGGCGCCCCCATCGAGAAA ACCATCTCCAAAGCCAAAGGGCAGCCCCGAGAACCACA GGTGTGCACCCTGCCCCCATCCCGGGATGAGCTGACCAA GAACCAGGTCAGCCTCTCGTGCGCAGTCAAAGGCTTCTA TCCCAGCGACATCGCCGTGGAGTGGGAGAGCAATGGGC AGCCGGAGAACAACTACAAGACCACGCCTCCCGTGCTG GACTCCGACGGCTCCTTCTTCCTCGTGAGCAAGCTCACC GTGGACAAGAGCAGGTGGCAGCAGGGGAACGTCTTCTC ATGCTCCGTGATGCATGAGGCTCTGCACAACCACTACAC GCAGAAGAGCCTCTCCCTGTCTCCGGGTGGAGGCGGCG GAAGCGGAGGAGGAGGATCCAGAGAGGGCCCTGAGCTG AGCCCCGATGATCCTGCTGGACTGCTGGACCTGCGGCAG GGCATGTTTGCTCAGCTGGTGGCCCAGAACGTGCTGCTG ATCGATGGCCCCCTGTCCTGGTACAGCGATCCTGGACTG GCTGGCGTGTCACTGACAGGCGGCCTGAGCTACAAAGA GGACACCAAAGAACTGGTGGTGGCCAAGGCCGGCGTGT ACTACGTGTTCTTTCAGCTGGAACTGCGGAGAGTGGTGG CCGGCGAAGGATCTGGCTCTGTGTCTCTGGCCCTGCATC TGCAGCCTCTGAGAAGCGCTGCTGGCGCTGCAGCTCTGG CACTGACAGTGGATCTGCCTCCTGCCAGCTCCGAGGCCC GGAATAGCGCATTTGGGTTTCAAGGCAGGCTGCTGCACC TGTCTGCCGGCCAGAGGCTGGGAGTGCATCTGCACACA GAGGCCAGGGCTAGACACGCCTGGCAGCTGACACAGGG CGCTACAGTGCTGGGCCTGTTCAGAGTGACCCCCGAGAT TCCAGCCGGCCTGCCTTCTCCAAGAAGCGAAGGCGGAG GCGGATCTGGCGGCGGAGGATCTAGAGAGGGACCCGAA CTGTCCCCTGACGATCCAGCCGGGCTGCTGGATCTGAGA CAGGGAATGTTCGCCCAGCTGGTGGCTCAGAATGTGCTG CTGATTGACGGACCTCTGAGCTGGTACTCCGACCCAGGG CTGGCAGGGGTGTCCCTGACTGGGGGACTGTCCTACAAA GAAGATACAAAAGAACTGGTGGTGGCTAAAGCTGGGGT GTACTATGTGTTTTTTCAGCTGGAACTGAGGCGGGTGGT GGCTGGGGAGGGCTCAGGATCTGTGTCCCTGGCTCTGCA TCTGCAGCCACTGCGCTCTGCTGCTGGCGCAGCTGCACT GGCTCTGACTGTGGACCTGCCACCAGCCTCTAGCGAGGC CAGAAACAGCGCCTTCGGGTTCCAAGGACGCCTGCTGC ATCTGAGCGCCGGACAGCGCCTGGGAGTGCATCTGCAT ACTGAAGCCAGAGCCCGGCATGCTTGGCAGCTGACTCA GGGGGCAACTGTGCTGGGACTGTTTCGCGTGACACCTGA GATCCCTGCCGGACTGCCAAGCCCTAGATCAGAA |
| 142 | anti-FAP (28H1) Fc knob chain fused to monomeric hu 4-1BBL (71-254) | GAAGTGCAGCTGCTGGAATCCGGCGGAGGCCTGGTGCA GCCTGGCGGATCTCTGAGACTGTCCTGCGCCGCCTCCGG CTTCACCTTCTCCTCCCACGCCATGTCCTGGGTCCGACA GGCTCCTGGCAAAGGCCTGGAATGGGTGTCCGCCATCTG GGCCTCCGGCGAGCAGTACTACGCCGACTCTGTGAAGG GCCGGTTCACCATCTCCCGGGACAACTCCAAGAACACCC TGTACCTGCAGATGAACTCCCTGCGGGCCGAGGACACC GCCGTGTACTACTGTGCCAAGGGCTGGCTGGGCAACTTC GACTACTGGGGACAGGGCACCCTGGTCACCGTGTCCAG CGCTAGCACCAAGGGCCCCATCGGTCTTCCCCCTGGCACC CTCCTCCAAGAGCACCTCTGGGGGCACAGCGGCCCTGG GCTGCCTGGTCAAGGACTACTTCCCCGAACCGGTGACGG TGTCGTGGAACTCAGGCGCCCTGACCAGCGGCGTGCAC ACCTTCCCGGCTGTCCTACAGTCCTCAGGACTCTACTCC |

TABLE 6-continued

Sequences of FAP-targeted human 4-1BB ligand trimer containing Fc (kih) fusion molecule Construct 1.5

| SEQ ID NO: | Description | Sequence |
|---|---|---|
| | | CTCAGCAGCGTGGTGACCGTGCCCTCCAGCAGCTTGGGC ACCCAGACCTACATCTGCAACGTGAATCACAAGCCCAG CAACACCAAGGTGGACAAGAAAGTTGAGCCCAAATCTT GTGACAAAACTCACACATGCCCACCGTGCCCAGCACCT GAAGCTGCAGGGGGACCGTCAGTCTTCCTCTTCCCCCCA AAACCCAAGGACACCCTCATGATCTCCCGGACCCCTGA GGTCACATGCGTGGTGGTGGACGTGAGCCACGAAGACC CTGAGGTCAAGTTCAACTGGTACGTGGACGGCGTGGAG GTGCATAATGCCAAGACAAAGCCGCGGGAGGAGCAGTA CAACAGCACGTACCGTGTGGTCAGCGTCCTCACCGTCCT GCACCAGGACTGGCTGAATGGCAAGGAGTACAAGTGCA AGGTCTCCAACAAAGCCCTCGGCGCCCCCATCGAGAAA ACCATCTCCAAAGCCAAAGGGCAGCCCCGAGAACCACA GGTGTACACCCTGCCCCCCTGCAGAGATGAGCTGACCA AGAACCAGGTGTCCCTGTGGTGTCTGGTCAAGGGCTTCT ACCCCAGCGATATCGCCGTGGAGTGGGAGAGCAACGGC CAGCCTGAGAACAACTACAAGACCACCCCCCCTGTGCT GGACAGCGACGGCAGCTTCTTCCTGTACTCCAAACTGAC CGTGGACAAGAGCCGGTGGCAGCAGGGCAACGTGTTCA GCTGCAGCGTGATGCACGAGGCCCTGCACAACCACTAC ACCCAGAAGTCCCTGAGCCTGAGCCCCGGCGGAGGCGG CGGAAGCGGAGGAGGAGGATCCAGAGAGGGCCCTGAG CTGAGCCCCGATGATCCTGCTGGACTGCTGGACCTGCGG CAGGGCATGTTTGCTCAGCTGGTGGCCCAGAACGTGCTG CTGATCGATGGCCCCCTGTCCTGGTACAGCGATCCTGGA CTGGCTGGCGTGTCACTGACAGGCGGCCTGAGCTACAA AGAGGACACCAAAGAACTGGTGGTGGCCAAGGCCGGCG TGTACTACGTGTTCTTTCAGCTGGAACTGCGGAGAGTGG TGGCCGGCGAAGGATCTGGCTCTGTGTCTCTGGCCCTGC ATCTGCAGCCTCTGAGAAGCGCTGCTGGCGCTGCAGCTC TGGCACTGACAGTGGATCTGCCTCCTGCCAGCTCCGAGG CCCGGAATAGCGCATTTGGGTTTCAAGGCAGGCTGCTGC ACCTGTCTGCCGGCCAGAGGCTGGGAGTGCATCTGCAC ACAGAGGCCAGGGCTAGACACGCCTGGCAGCTGACACA GGGCGCTACAGTGCTGGGCCTGTTCAGAGTGACCCCCG AGATTCCAGCCGGCCTGCCTTCTCAAGAAGCGAA |
| 69 | anti-FAP (28H1) light chain | see Table 2 |
| 121 | anti-FAP (28H1) Fc hole chain fused to dimeric hu 4-1BBL (71-254) | EVQLLESGGGLVQPGGSLRLSCAASGFTFSSHAMSWVRQA PGKGLEWVSAIWASGEQYYADSVKGRFTISRDNSKNTLYL QMNSLRAEDTAVYYCAKGWLGNFDYWGQGTLVTVSSAS TKGPSVFPLAPSSKSTSGGTAALGCLVKDYFPEPVTVSWNS GALTSGVHTFPAVLQSSGLYSLSSVVTVPSSSLGTQTYICN VNHKPSNTKVDKKVEPKSCDKTHTCPPCPAPEAAGGPSVF LFPPKPKDTLMISRTPEVTCVVVDVSHEDPEVKFNWYVDG VEVHNAKTKPREEQYNSTYRVVSVLTVLHQDWLNGKEYK CKVSNKALGAPIEKTISKAKGQPREPQVCTLPPSRDELTKN QVSLSCAVKGFYPSDIAVEWESNGQPENNYKTTPPVLDSD GSFFLVSKLTVDKSRWQQGNVFSCSVMHEALHNHYTQKS LSLSPGGGGSGGGGSREGPELSPDDPAGLLDLRQGMFAQ LVAQNVLLIDGPLSWYSDPGLAGVSLTGGLSYKEDTKELV VAKAGVYYVFFQLELRRVVAGEGSGSVSLALHLQPLRSAA GAAALALTVDLPPASSEARNSAFGFQGRLLHLSAGQRLGV HLHTEARARHAWQLTQGATVLGLFRVTPEIPAGLPSPRSEG GGGSGGGGSREGPELSPDDPAGLLDLRQGMFAQLVAQNV LLIDGPLSWYSDPGLAGVSLTGGLSYKEDTKELVVAKAGV YYVFFQLELRRVVAGEGSGSVSLALHLQPLRSAAGAAALA LTVDLPPASSEARNSAFGFQGRLLHLSAGQRLGVHLHTEA RARHAWQLTQGATVLGLFRVTPEIPAGLPSPRSE |
| 122 | anti-FAP (28H1) Fc knob chain fused to monomeric hu 4-1BBL (71-254) | EVQLLESGGGLVQPGGSLRLSCAASGFTFSSHAMSWVRQA PGKGLEWVSAIWASGEQYYADSVKGRFTISRDNSKNTLYL QMNSLRAEDTAVYYCAKGWLGNFDYWGQGTLVTVSSAS TKGPSVFPLAPSSKSTSGGTAALGCLVKDYFPEPVTVSWNS GALTSGVHTFPAVLQSSGLYSLSSVVTVPSSSLGTQTYICN VNHKPSNTKVDKKVEPKSCDKTHTCPPCPAPEAAGGPSVF LFPPKPKDTLMISRTPEVTCVVVDVSHEDPEVKFNWYVDG VEVHNAKTKPREEQYNSTYRVVSVLTVLHQDWLNGKEYK CKVSNKALGAPIEKTISKAKGQPREPQVYTLPPCRDELTKN QVSLWCLVKGFYPSDIAVEWESNGQPENNYKTTPPVLDSD GSFFLYSKLTVDKSRWQQGNVFSCSVMHEALHNHYTQKS LSLSPGGGGSGGGGSREGPELSPDDPAGLLDLRQGMFAQ |

TABLE 6-continued

Sequences of FAP-targeted human 4-1BB ligand trimer containing Fc (kih) fusion molecule Construct 1.5

| SEQ ID NO: | Description | Sequence |
|---|---|---|
|  |  | LVAQNVLLIDGPLSWYSDPGLAGVSLTGGLSYKEDTKELV VAKAGVYYVFFQLELRRVVAGEGSGSVSLALHLQPLRSAA GAAALALTVDLPPASSEARNSAFGFQGRLLHLSAGQRLGV HLHTEARARHAWQLTQGATVLGLFRVTPEIPAGLPSPRSE |
| 19 | anti-FAP (28H1) light chain | see Table 2 |

Table 7 shows the cDNA and amino acid sequences of the monovalent FAP-targeted 4-1BB ligand trimer-containing Fc (kih) fusion molecule Construct 1.6 (FIG. 2F) (FAP split trimer with anti-FAP Fab, monomeric 4-1BB ligand fused to CL* via a (G4S)-linker).

TABLE 7

Sequences of FAP-targeted human 4-1BB ligand trimer containing Fc (kih) fusion molecule Construct 1.6

| SEQ ID NO: | Description | Sequence |
|---|---|---|
| 131 | Dimeric hu 4-1BBL (71-254)-CH1* Fc knob chain | see Table 4 |
| 143 | Monomeric hu 4-1BBL (71-254)-(G4S)$_1$-CL* | AGAGAGGGCCCTGAGCTGAGCCCCGATGATCCTGCTGG ACTGCTGGACCTGCGGCAGGGCATGTTTGCTCAGCTGGT GGCCCAGAACGTGCTGCTGATCGATGGCCCCCTGTCCTG GTACAGCGATCCTGGACTGGCTGGCGTGTCACTGACAGG CGGCCTGAGCTACAAAGAGGACACCAAAGAACTGGTGG TGGCCAAGGCCGGCGTGTACTACGTGTTCTTTCAGCTGG AACTGCGGAGAGTGGTGGCCGGCGAAGGATCTGGCTCT GTGTCTCTGGCCCTGCATCTGCAGCCTCTGAGAAGCGCT GCTGGCGCTGCAGCTCTGGCACTGACAGTGGATCTGCCT CCTGCCAGCTCCGAGGCCCGGAATAGCGCATTTGGGTTT CAAGGCAGGCTGCTGCACCTGTCTGCCGGCCAGAGGCT GGGAGTGCATCTGCACACAGAGGCCAGGGCTAGACACG CCTGGCAGCTGACACAGGGCGCTACAGTGCTGGGCCTG TTCAGAGTGACCCCCGAGATTCCAGCCGGCCTGCCTTCT CCAAGAAGCGAAGGCGGAGGCGGATCTCGTACGGTGGC TGCACCATCTGTCTTCATCTTCCCGCCATCTGATCGGAA GTTGAAATCTGGAACTGCCTCTGTTGTGTGCCTGCTGAA TAACTTCTATCCCAGAGAGGCCAAAGTACAGTGGAAGG TGGATAACGCCCTCCAATCGGGTAACTCCCAGGAGAGT GTCACAGAGCAGGACAGCAAGGACAGCACCTACAGCCT CAGCAGCACCCTGACGCTGAGCAAAGCAGACTACGAGA AACACAAAGTCTACGCCTGCGAAGTCACCCATCAGGGC CTGAGCTCGCCCGTCACAAAGAGCTTCAACAGGGGAGA GTGT |
| 68 | anti-FAP (28H1) Fc hole chain | see Table 2 |
| 69 | anti-FAP (28H1) light chain | see Table 2 |
| 108 | Dimeric hu 4-1BBL (71-254)-CH1* Fc knob chain | see Table 4 |
| 110 | Monomeric hu 4-1BBL (71-254)-(G4S)$_1$-CL* | REGPELSPDDPAGLLDLRQGMFAQLVAQNVLLIDGPLSWY SDPGLAGVSLTGGLSYKEDTKELVVAKAGVYYVFFQLELR RVVAGEGSGSVSLALHLQPLRSAAGAAALALTVDLPPASS EARNSAFGFQGRLLHLSAGQRLGVHLHTEARARHAWQLT QGATVLGLFRVTPEIPAGLPSPRSEGGGGSRTVAAPSVFIFP PSDRKLKSGTASVVCLLNNFYPREAKVQWKVDNALQSGN SQESVTEQDSKDSTYSLSSTLTLSKADYEKHKVYACEVTH QGLSSPVTKSFNRGEC |

TABLE 7-continued

Sequences of FAP-targeted human 4-1BB ligand trimer containing Fc (kih) fusion molecule Construct 1.6

| SEQ ID NO: | Description | Sequence |
|---|---|---|
| 18 | anti-FAP (28H1) Fc hole chain | see Table 2 |
| 19 | anti-FAP (28H1) light chain | see Table 2 |

Table 8 shows the cDNA and amino acid sequences of the bivalent FAP-targeted 4-1BB ligand trimer-containing Fc (kih) fusion molecule Construct 1.7 (FIG. 2G) (FAP split trimer with double anti-FAP on the N-terminus of Fc hole chain and charged residues on crossed CH1 and CL fused to 4-1BB ligands).

TABLE 8

Sequences of FAP-targeted human 4-1BB ligand trimer containing Fc (kih) fusion molecule Construct 1.7

| SEQ ID NO: | Description | Sequence |
|---|---|---|
| 129 | Dimeric hu 4-1BBL (71-254)-CL* Fc knob chain | see Table 3 |
| 130 | Monomeric hu 4-1BBL (71-254)-CH1* | see Table 3 |
| 144 | [anti-FAP (28H1)]₂ Fc hole chain | GAAGTGCAGCTGCTGGAATCCGGCGGAGGCCTGGTGCA GCCTGGCGGATCTCTGAGACTGTCCTGCGCCGCCTCCGG CTTCACCTTCTCCTCCCACGCCATGTCCTGGGTCCGACA GGCTCCTGGCAAAGGCCTGGAATGGGTGTCCGCCATCTG GGCCTCCGGCGAGCAGTACTACGCCGACTCTGTGAAGG GCCGGTTCACCATCTCCCGGGACAACTCCAAGAACACCC TGTACCTGCAGATGAACTCCCTGCGGGCCGAGGACACC GCCGTGTACTACTGTGCCAAGGGCTGGCTGGGCAACTTC GACTACTGGGGACAGGGCACCCTGGTCACCGTGTCCAG CGCTAGCACAAAGGGACCTAGCGTGTTCCCCCTGGCCCC CAGCAGCAAGTCTACATCTGGCGGAACAGCCGCCCTGG GCTGCCTCGTGAAGGACTACTTTCCCGAGCCCGTGACCG TGTCCTGGAACTCTGGCGCTCTGACAAGCGGCGTGCACA CCTTTCCAGCCGTGCTGCAGAGCAGCGGCCTGTACTCTC TGAGCAGCGTCGTGACAGTGCCCAGCAGCTCTCTGGGC ACCCAGACCTACATCTGCAACGTGAACCACAAGCCCAG CAACACCAAGGTGGACAAGAAGGTGGAACCCAAGAGCT GCGACGGCGGAGGGGGATCTGGCGGCGGAGGATCCGAA GTGCAGCTGCTGGAATCCGGCGGAGGCCTGGTGCAGCC TGGCGGATCTCTGAGACTGTCCTGCGCCGCCTCCGGCTT CACCTTCTCCTCCCACGCCATGTCCTGGGTCCGACAGGC TCCTGGCAAAGGCCTGGAATGGGTGTCCGCCATCTGGGC CTCCGGCGAGCAGTACTACGCCGACTCTGTGAAGGGCC GGTTCACCATCTCCCGGGACAACTCCAAGAACACCCTGT ACCTGCAGATGAACTCCCTGCGGGCCGAGGACACCGCC GTGTACTACTGTGCCAAGGGCTGGCTGGGCAACTTCGAC TACTGGGGACAGGGCACCCTGGTCACCGTGTCCAGCGCT AGCACCAAGGGCCCCTCCGTGTTCCCCCTGGCCCCCAGC AGCAAGAGCACCAGCGGCGGCACAGCCGCTCTGGGCTG CCTGGTCAAGGACTACTTCCCCGAGCCCGTGACCGTGTC CTGGAACAGCGGAGCCCTGACCTCCGGCGTGCACACCTT CCCCGCCGTGCTGCAGAGTTCTGGCCTGTATAGCCTGAG CAGCGTGGTCACCGTGCCTTCTAGCAGCCTGGGCACCCA GACCTACATCTGCAACGTGAACCACAAGCCCAGCAACA CCAAGGTGGACAAGAAGGTGGAGCCCAAGAGCTGCGAC AAAACTCACACATGCCCACCGTGCCCAGCACCTGAAGC TGCAGGGGGACCGTCAGTCTTCCTCTTCCCCCCAAAACC CAAGGACACCCTCATGATCTCCCGGACCCCTGAGGTCAC ATGCGTGGTGGTGGACGTGAGCCACGAAGACCCTGAGG TCAAGTTCAACTGGTACGTGGACGGCGTGGAGGTGCAT AATGCCAAGACAAAGCCGCGGGAGGAGCAGTACAACA GCACGTACCGTGTGGTCAGCGTCCTCACCGTCCTGCACC AGGACTGGCTGAATGGCAAGGAGTACAAGTGCAAGGTC |

TABLE 8-continued

Sequences of FAP-targeted human 4-1BB ligand trimer containing Fc (kih) fusion molecule Construct 1.7

| SEQ ID NO: | Description | Sequence |
|---|---|---|
| | | TCCAACAAAGCCCTCGGCGCCCCCATCGAGAAAACCAT CTCCAAAGCCAAAGGGCAGCCCCGAGAACCACAGGTGT GCACCCTGCCCCCATCCCGGGATGAGCTGACCAAGAAC CAGGTCAGCCTCTCGTGCGCAGTCAAAGGCTTCTATCCC AGCGACATCGCCGTGGAGTGGGAGAGCAATGGGCAGCC GGAGAACAACTACAAGACCACGCCTCCCGTGCTGGACT CCGACGGCTCCTTCTTCCTCGTGAGCAAGCTCACCGTGG ACAAGAGCAGGTGGCAGCAGGGGAACGTCTTCTCATGC TCCGTGATGCATGAGGCTCTGCACAACCACTACACGCAG AAGAGCCTCTCCCTGTCTCCGGGTAAA |
| 69 | anti-FAP (28H1) light chain | see Table 2 |
| 115 | Dimeric hu 4-1BBL (71-254)-CL* Fc knob chain | see Table 3 |
| 116 | Monomeric hu 4-1BBL (71-254)-CH1* | see Table 3 |
| 145 | [anti-FAP (28H1)]$_2$ Fc hole chain | EVQLLESGGGLVQPGGSLRLSCAASGFTFSSHAMSWVRQA PGKGLEWVSAIWASGEQYYADSVKGRFTISRDNSKNTLYL QMNSLRAEDTAVYYCAKGWLGNFDYWGQGTLVTVSSAS TKGPSVFPLAPSSKSTSGGTAALGCLVKDYFPEPVTVSWNS GALTSGVHTFPAVLQSSGLYSLSSVVTVPSSSLGTQTYICN VNHKPSNTKVDKKVEPKSCDGGGGSGGGGSEVQLLESGG GLVQPGGSLRLSCAASGFTFSSHAMSWVRQAPGKGLEWV SAIWASGEQYYADSVKGRFTISRDNSKNTLYLQMNSLRAE DTAVYYCAKGWLGNFDYWGQGTLVTVSSASTKGPSVFPL APSSKSTSGGTAALGCLVKDYFPEPVTVSWNSGALTSGVH TFPAVLQSSGLYSLSSVVTVPSSSLGTQTYICNVNHKPSNT KVDKKVEPKSCDKTHTCPPCPAPEAAGGPSVFLFPPKPKDT LMISRTPEVTCVVVDVSHEDPEVKFNWYVDGVEVHNAKT KPREEQYNSTYRVVSVLTVLHQDWLNGKEYKCKVSNKAL GAPIEKTISKAKGQPREPQVCTLPPSRDELTKNQVSLSCAV KGFYPSDIAVEWESNGQPENNYKTTPPVLDSDGSFFLVSKL TVDKSRWQQGNVFSCSVMHEALHNHYTQKSLSLSPGK |
| 19 | anti-FAP (28H1) light chain | see Table 2 |

Figure 2H:
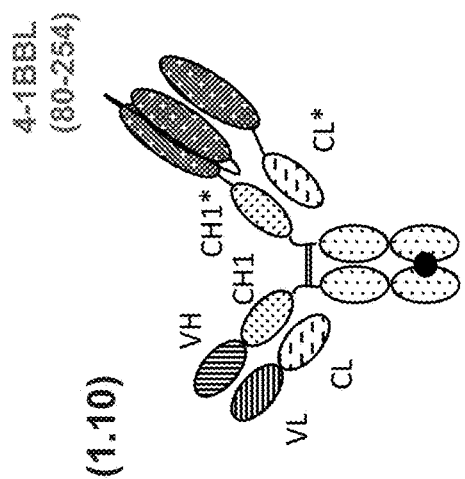

Table 9 shows the cDNA and amino acid sequences of the bivalent FAP-targeted 4-1BB ligand trimer-containing Fc (kih) fusion molecule Construct 1.8 (FIG. 2H) (FAP split trimer with 4-1BB ligands fused to anti-FAP CrossFab, with charged residues, on knob chain).

TABLE 9

Sequences of FAP-targeted human 4-1BB ligand trimer containing Fc (kih) fusion molecule Construct 1.8

| SEQ ID NO: | Description | Sequence |
|---|---|---|
| 146 | Dimeric hu 4-1BBL (71-254)-FAP (VHCL*) Fc knob chain | AGAGAGGGCCCTGAGCTGAGCCCCGATGATCCTGCTGG ACTGCTGGACCTGCGGCAGGGCATGTTTGCTCAGCTGGT GGCCCAGAACGTGCTGCTGATCGATGGCCCCCTGTCCTG GTACAGCGATCCTGGACTGGCTGGCGTGTCACTGACAGG CGGCCTGAGCTACAAAGAGGACACCAAAGAACTGGTGG TGGCCAAGGCCGGCGTGTACTACGTGTTCTTTCAGCTGG AACTGCGGAGAGTGGTGGCCGGCGAAGGATCTGGCTCT GTGTCTCTGGCCCTGCATCTGCAGCCTCTGAGAAGCGCT GCTGGCGCTGCAGCTCTGGCACTGACAGTGGATCTGCCT CCTGCCAGCTCCGAGGCCCGGAATAGCGCATTTGGGTTT CAAGGCAGGCTGCTGCACCTGTCTGCCGGCCAGAGGCT GGGAGTGCATCTGCACACAGAGGCCAGGGCTAGACACG CCTGGCAGCTGACACAGGGCGCTACAGTGCTGGGCCTG |

TABLE 9-continued

Sequences of FAP-targeted human 4-1BB ligand trimer containing Fc (kih) fusion molecule Construct 1.8

| SEQ ID NO: | Description | Sequence |
|---|---|---|
| | | TTCAGAGTGACCCCCGAGATTCCAGCCGGCCTGCCTTCT
CCAAGAAGCGAAGGCGGAGGCGGATCTGGCGGCGGAG
GATCTAGAGAGGGACCCGAACTGTCCCCTGACGATCCA
GCCGGGCTGCTGGATCTGAGACAGGGAATGTTCGCCCA
GCTGGTGGCTCAGAATGTGCTGCTGATTGACGGACCTCT
GAGCTGGTACTCCGACCCAGGGCTGGCAGGGGTGTCCC
TGACTGGGGGACTGTCCTACAAAGAAGATACAAAAGAA
CTGGTGGTGGCTAAAGCTGGGGTGTACTATGTGTTTTTT
CAGCTGGAACTGAGGCGGGTGGTGGCTGGGGAGGGCTC
AGGATCTGTGTCCCTGGCTCTGCATCTGCAGCCACTGCG
CTCTGCTGCTGGCGCAGCTGCACTGGCTCTGACTGTGGA
CCTGCCACCAGCCTCTAGCGAGGCCAGAAACAGCGCCT
TCGGGTTCCAAGGACGCCTGCTGCATCTGAGCGCCGGAC
AGCGCCTGGGAGTGCATCTGCATACTGAAGCCAGAGCC
CGGCATGCTTGGCAGCTGACTCAGGGGGCAACTGTGCTG
GGACTGTTTCGCGTGACACCTGAGATCCCTGCCGGACTG
CCAAGCCCTAGATCAGAAGGGGGCGGAGGTTCCGGAGG
CGGAGGATCTGAGGTGCAGCTGCTGGAATCCGGCGGAG
GCCTGGTGCAGCCTGGCGGATCTCTGAGACTGTCCTGCG
CCGCCTCCGGCTTCACCTTCTCCTCCCACGCCATGTCCTG
GGTCCGACAGGCTCCTGGCAAAGGCCTGGAATGGGTGT
CCGCCATCTGGGCCTCCGGCGAGCAGTACTACGCCGACT
CTGTGAAGGGCCGGTTCACCATCTCCCGGGACAACTCCA
AGAACACCCTGTACCTGCAGATGAACTCCCTGCGGGCC
GAGGACACCGCCGTGTACTACTGTGCCAAGGGCTGGCT
GGGCAACTTCGACTACTGGGGCCAGGGCACCCTGGTCA
CCGTGTCCAGCGCTAGCGTGGCTGCACCATCTGTCTTTA
TCTTCCCACCCAGCGACCGGAAGCTGAAGTCTGGCACA
GCCAGCGTCGTGTGCCTGCTGAATAACTTCTACCCCCGC
GAGGCCAAGGTGCAGTGGAAGGTGGACAATGCCCTGCA
GAGCGGCAACAGCCAGGAAAGCGTGACCGAGCAGGAC
AGCAAGGACTCCACCTACAGCCTGAGCAGCACCCTGAC
CCTGAGCAAGGCCGACTACGAGAAGCACAAGGTGTACG
CCTGCGAAGTGACCCACCAGGGCCTGTCTAGCCCCGTGA
CCAAGAGCTTCAACCGGGGCGAGTGCGACAAGACCCAC
ACCTGTCCTCCATGCCCTGCCCCTGAAGCTGCTGGCGGC
CCTAGCGTGTTCCTGTTCCCCCCAAAGCCCAAGGACACC
CTGATGATCAGCCGGACCCCTGAAGTGACCTGCGTGGTG
GTGGATGTGTCCCACGAGGACCCTGAAGTGAAGTTCAAT
TGGTACGTGGACGGCGTGGAAGTGCACAATGCCAAGAC
CAAGCCGCGGGAGGAGCAGTACAACAGCACGTACCGTG
TGGTCAGCGTCCTCACCGTCCTGCACCAGGACTGGCTGA
ATGGCAAGGAGTACAAGTGCAAGGTCTCCAACAAAGCC
CTCGGCGCCCCCATCGAGAAAACCATCTCCAAAGCCAA
AGGGCAGCCCCGAGAACCACAGGTGTACACCCTGCCCC
CATGCCGGGATGAGCTGACCAAGAACCAGGTCAGCCTG
TGGTGCCTGGTCAAAGGCTTCTATCCCAGCGACATCGCC
GTGGAGTGGGAGAGCAATGGGCAGCCGGAGAACAACTA
CAAGACCACGCCTCCCGTGCTGGACTCCGACGGCTCCTT
CTTCCTCTACAGCAAGCTCACCGTGGACAAGAGCAGGT
GGCAGCAGGGGAACGTCTTCTCATGCTCCGTGATGCATG
AGGCTCTGCACAACCACTACACGCAGAAGAGCCTCTCC
CTGTCTCCGGGTAAA |
| 147 | Monomeric hu 4-1BBL (71-254)-FAP (VLCH1*) | AGAGAGGGCCCTGAGCTGAGCCCCGATGATCCTGCTGG
ACTGCTGGACCTGCGGCAGGGCATGTTTGCTCAGCTGGT
GGCCCAGAACGTGCTGCTGATCGATGGCCCCCTGTCCTG
GTACAGCGATCCTGGACTGGCTGGCGTGTCACTGACAGG
CGGCCTGAGCTACAAAGAGGACACCAAAGAACTGGTGG
TGGCCAAGGCCGGCGTGTACTACGTGTTCTTTCAGCTGG
AACTGCGGAGAGTGGTGGCCGGCGAAGGATCTGGCTCT
GTGTCTCTGGCCCTGCATCTGCAGCCTCTGAGAAGCGCT
GCTGGCGCTGCAGCTCTGGCTCTGACAGTGGATCTGCCT
CCTGCCAGCTCCGAGGCCCGGAATAGCGCATTTGGGTTT
CAAGGCCGGCTGCTGCACCTGTCTGCCGGCCAGAGACT
GGGAGTGCATCTGCACACAGAGGCCAGAGCCAGGCACG
CCTGGCAGCTGACACAGGGCGCTACAGTGCTGGGCCTG
TTCAGAGTGACCCCCGAGATTCCTGCCGGCCTGCCTAGC
CCTAGATCTGAAGGCGGCGGAGGTTCCGGAGGCGGAGG
ATCTGAGATCGTGCTGACCCAGTCTCCCGGCACCCTGAG
CCTGAGCCCTGGCGAGAGAGCCACCCTGAGCTGCAGAG
CCAGCCAGAGCGTGAGCCGGAGCTACCTGGCCTGGTAT
CAGCAGAAGCCCGGCCAGGCCCCCAGACTGCTGATCAT
CGGCGCCAGCACCCGGGCCACCGGCATCCCCGATAGAT |

TABLE 9-continued

Sequences of FAP-targeted human 4-1BB ligand trimer containing Fc (kih) fusion molecule Construct 1.8

| SEQ ID NO: | Description | Sequence |
|---|---|---|
| | | TCAGCGGCAGCGGCTCCGGCACCGACTTCACCCTGACCA<br>TCAGCCGGCTGGAACCCGAGGACTTCGCCGTGTACTACT<br>GCCAGCAGGGCCAGGTGATCCCCCCCACCTTCGGCCAG<br>GGCACCAAGGTGGAAATCAAGTCCTCTGCTAGCACAAA<br>GGGCCCCAGCGTGTTCCCTCTGGCCCCTAGCAGCAAGAG<br>CACATCTGGCGGAACAGCCGCCCTGGGCTGCCTGGTGG<br>AAGATTACTTCCCCGAGCCCGTGACCGTGTCCTGGAATT<br>CTGGCGCCCTGACAAGCGGCGTGCACACCTTCCAGCCG<br>TGCTGCAGAGCAGCGGCCTGTACTCTCTGAGCAGCGTCG<br>TGACAGTGCCCAGCAGCTCTCTGGGCACCCAGACCTACA<br>TCTGCAACGTGAACCACAAGCCCAGCAACACCAAGGTG<br>GACGAGAAGGTGGAACCCAAGTCCTGC |
| 68 | anti-FAP (28H1) Fc hole chain | see Table 2 |
| 69 | anti-FAP (28H1) light chain | see Table 2 |
| 148 | Dimeric hu 4-1BBL (71-254)-FAP (VHCL*) Fc knob chain | REGPELSPDDPAGLLDLRQGMFAQLVAQNVLLIDGPLSWY<br>SDPGLAGVSLTGGLSYKEDTKELVVAKAGVYYVFFQLELR<br>RVVAGEGSGSVSLALHLQPLRSAAGAAALALTVDLPPASS<br>EARNSAFGFQGRLLHLSAGQRLGVHLHTEARARHAWQLT<br>QGATVLGLFRVTPEIPAGLPSPRSEGGGGSGGGGSREGPEL<br>SPDDPAGLLDLRQGMFAQLVAQNVLLIDGPLSWYSDPGLA<br>GVSLTGGLSYKEDTKELVVAKAGVYYVFFQLELRRVVAG<br>EGSGSVSLALHLQPLRSAAGAAALALTVDLPPASSEARNS<br>AFGFQGRLLHLSAGQRLGVHLHTEARARHAWQLTQGATV<br>LGLFRVTPEIPAGLPSPRSEGGGGSGGGGSEVQLLESGGGL<br>VQPGGSLRLSCAASGFTFSSHAMSWVRQAPGKGLEWVSAI<br>WASGEQYYADSVKGRFTISRDNSKNTLYLQMNSLRAEDT<br>AVYYCAKGWLGNFDYWGQGTLVTVSSASVAAPSVFIFPPS<br>DRKLKSGTASVVCLLNNFYPREAKVQWKVDNALQSGNSQ<br>ESVTEQDSKDSTYSLSSTLTLSKADYEKHKVYACEVTHQG<br>LSSPVTKSFNRGECDKTHTCPPCPAPEAAGGPSVFLFPPKPK<br>DTLMISRTPEVTCVVVDVSHEDPEVKFNWYVDGVEVHNA<br>KTKPREEQYNSTYRVVSVLTVLHQDWLNGKEYKCKVSNK<br>ALGAPIEKTISKAKGQPREPQVYTLPPCRDELTKNQVSLWC<br>LVKGFYPSDIAVEWESNGQPENNYKTTPPVLDSDGSFFLYS<br>KLTVDKSRWQQGNVFSCSVMHEALHNHYTQKSLSLSPGK |
| 149 | Monomeric hu 4-1BBL (71-254)-FAP (VLCH1*) | REGPELSPDDPAGLLDLRQGMFAQLVAQNVLLIDGPLSWY<br>SDPGLAGVSLTGGLSYKEDTKELVVAKAGVYYVFFQLELR<br>RVVAGEGSGSVSLALHLQPLRSAAGAAALALTVDLPPASS<br>EARNSAFGFQGRLLHLSAGQRLGVHLHTEARARHAWQLT<br>QGATVLGLFRVTPEIPAGLPSPRSEGGGGSGGGGSEIVLTQS<br>PGTLSLSPGERATLSCRASQSVSRSYLAWYQQKPGQAPRL<br>LIIGASTRATGIPDRFSGSGSGTDFTLTISRLEPEDFAVYYCQ<br>QGQVIPPTFGQGTKVEIKSSASTKGPSVFPLAPSSKSTSGGT<br>AALGCLVEDYFPEPVTVSWNSGALTSGVHTFPAVLQSSGL<br>YSLSSVVTVPSSSLGTQTYICNVNHKPSNTKVDEKVEPKSC |
| 18 | anti-FAP (28H1) Fc hole chain | see Table 2 |
| 19 | anti-FAP (28H1) light chain | see Table 2 |

Figure 2I:
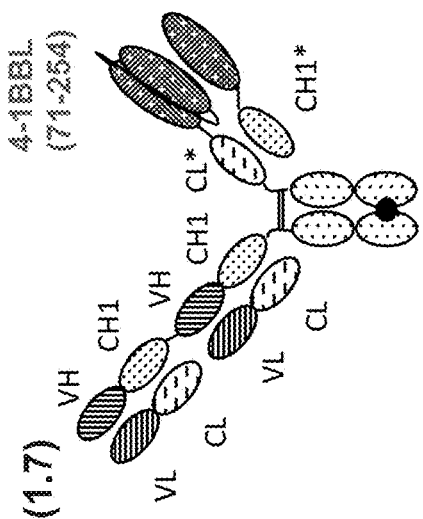

Table 10 shows the cDNA and amino acid sequences of the monovalent FAP-targeted 4-1BB ligand (52-254) trimer-containing Fc (kih) fusion molecule Construct 1.9 (FIG. 2I) (FAP split trimer with 4-1BBL ectodomain amino acids 52-254 and charged residues on ligand chains).

TABLE 10

Sequences of FAP-targeted human 4-1BB ligand trimer containing Fc (kih) fusion molecule Construct 1.9

| SEQ ID NO: | Description | Sequence |
|---|---|---|
| 150 | Dimeric hu 4-1BBL (52-254)-CH1* Fc knob chain | CCTTGGGCTGTGTCTGGCGCTAGAGCCTCTCCTGGATCT<br>GCCGCCAGCCCCAGACTGAGAGAGGGACCTGAGCTGAG<br>CCCCGATGATCCTGCCGGACTGCTGGATCTGAGACAGG<br>GCATGTTCGCCCAGCTGGTGGCCCAGAACGTGCTGCTGA<br>TCGATGGCCCCCTGTCCTGGTACAGCGATCCTGGACTGG<br>CTGGCGTGTCACTGACAGGCGGCCTGAGCTACAAAGAG<br>GACACCAAAGAACTGGTGGTGGCCAAGGCCGGCGTGTA<br>CTACGTGTTCTTTCAGCTGGAACTGCGGAGAGTGGTGGC<br>CGGCGAGGGATCTGGATCTGTGTCTCTGGCCCTGCATCT<br>GCAGCCCCTGAGAAGCGCTGCTGGCGCTGCAGCTCTGG<br>CACTGACAGTGGATCTGCCTCCTGCCAGCTCCGAGGCCC<br>GGAATAGCGCATTTGGGTTTCAAGGCAGACTGCTGCACC<br>TGTCTGCCGGCCAGAGGCTGGGAGTGCATCTGCACACA<br>GAGGCCAGGGCTAGACACGCCTGGCAGCTGACACAGGG<br>CGCTACAGTGCTGGGCCTGTTCAGAGTGACCCCCGAGAT<br>TCCAGCCGGACTGCCCAGCCCTAGATCTGAAGGCGGCG<br>GAGGAAGCGGAGGCGGAGGATCCCCTTGGGCTGTGTCT<br>GGCGCTAGAGCCTCTCCTGGATCTGCCGCCAGCCCCAGA<br>CTGAGAGAGGGACCTGAGCTGAGCCCCGATGATCCTGC<br>CGGACTGCTGGACCTGCGGCAGGGAATGTTCGCTCAGCT<br>GGTGGCTCAGAATGTGCTGCTGATTGACGGACCTCTGTC<br>CTGGTACTCCGACCCTGGCCTGGCAGGGGTGTCCCTGAC<br>TGGGGGACTGTCCTACAAAGAAGATACAAAAGAACTGG<br>TGGTGGCTAAAGCTGGGGTGTACTATGTGTTTTTTCAGC<br>TGGAACTGAGGCGGGTGGTGGCTGGGGAGGGCTCAGGA<br>TCTGTGTCCCTGGCTCTGCATCTGCAGCCTCTGCGCTCTG<br>CTGCTGGCGCAGCTGCACTGGCTCTGACTGTGGACCTGC<br>CACCAGCCTCTAGCGAGGCCAGAAACAGCGCCTTCGGG<br>TTCCAAGGACGGCTGCTGCATCTGAGCGCCGGACAGCG<br>CCTGGGAGTGCATCTGCATACTGAAGCCAGAGCCCGGC<br>ATGCTTGGCAGCTGACCCAGGGGCAACTGTGCTGGGA<br>CTGTTTCGCGTGACACCTGAGATCCCCGCTGGCCTGCCT<br>AGCCCAAGAAGTGAAGGGGGAGGCGGATCTGGCGGAG<br>GGGGATCTGCTAGCACCAAGGGCCCCTCCGTGTTCCCCC<br>TGGCCCCCAGCAGCAAGAGCACCAGCGGCGGCACAGCC<br>GCTCTGGGCTGCCTGGTCGAGGACTACTTCCCCGAGCCC<br>GTGACCGTGTCCTGGAACAGCGGAGCCCTGACCTCCGG<br>CGTGCACACCTTCCCCGCCGTGCTGCAGAGTTCTGGCCT<br>GTATAGCCTGAGCAGCGTGGTCACCGTGCCTTCTAGCAG<br>CCTGGGCACCCAGACCTACATCTGCAACGTGAACCACA<br>AGCCCAGCAACACCAAGGTGGACGAGAAGGTGGAGCCC<br>AAGAGCTGCGACAAAACTCACACATGCCCACCGTGCCC<br>AGCACCTGAAGCTGCAGGGGGACCGTCAGTCTTCCTCTT<br>CCCCCCAAAACCCAAGGACACCCTCATGATCTCCCGGAC<br>CCCTGAGGTCACATGCGTGGTGGTGGACGTGAGCCACG<br>AAGACCCTGAGGTCAAGTTCAACTGGTACGTGGACGGC<br>GTGGAGGTGCATAATGCCAAGACAAAGCCGCGGGAGGA<br>GCAGTACAACAGCACGTACCGTGTGGTCAGCGTCCTCAC<br>CGTCCTGCACCAGGACTGGCTGAATGGCAAGGAGTACA<br>AGTGCAAGGTCTCCAACAAAGCCCTCGGCGCCCCCATC<br>GAGAAAACCATCTCCAAAGCCAAAGGGCAGCCCCGAGA<br>ACCACAGGTGTACACCCTGCCCCCATGCCGGGATGAGCT<br>GACCAAGAACCAGGTCAGCCTGTGGTGCCTGGTCAAAG<br>GCTTCTATCCCAGCGACATCGCCGTGGAGTGGGAGAGC<br>AATGGGCAGCCGGAGAACAACTACAAGACCACGCCTCC<br>CGTGCTGGACTCCGACGGCTCCTTCTTCCTCTACAGCAA<br>GCTCACCGTGGACAAGAGCAGGTGGCAGCAGGGGAACG<br>TCTTCTCATGCTCCGTGATGCATGAGGCTCTGCACAACC<br>ACTACACGCAGAAGAGCCTCTCCCTGTCTCCGGGTAAA |
| 151 | Monomeric hu 4-1BBL (52-254)-CL* | CCTTGGGCTGTGTCTGGCGCTAGAGCCTCTCCTGGATCT<br>GCCGCCAGCCCCAGACTGAGAGAGGGACCTGAGCTGAG<br>CCCCGATGATCCTGCCGGACTGCTGGATCTGAGACAGG<br>GCATGTTCGCCCAGCTGGTGGCCCAGAACGTGCTGCTGA<br>TCGATGGCCCCCTGTCCTGGTACAGCGATCCTGGACTGG<br>CTGGCGTGTCACTGACAGGCGGCCTGAGCTACAAAGAG<br>GACACCAAAGAACTGGTGGTGGCCAAGGCCGGCGTGTA |

TABLE 10-continued

Sequences of FAP-targeted human 4-1BB ligand trimer
containing Fc (kih) fusion molecule Construct 1.9

| SEQ ID NO: | Description | Sequence |
|---|---|---|
| | | CTACGTGTTCTTTCAGCTGGAACTGCGGAGAGTGGTGGC CGGCGAGGGATCTGGATCTGTGTCTCTGGCCCTGCATCT GCAGCCCCTGAGAAGCGCTGCTGGCGCTGCAGCTCTGG CACTGACAGTGGATCTGCCTCCTGCCAGCTCCGAGGCCC GGAATAGCGCATTTGGGTTTCAAGGCAGGCTGCTGCACC TGTCTGCCGGCCAGAGGCTGGGAGTGCATCTGCACACA GAGGCCAGGGCTAGACACGCCTGGCAGCTGACACAGGG CGCTACAGTGCTGGGCCTGTTCAGAGTGACCCCCGAGAT TCCAGCCGGCCTGCCTTCTCCAAGAAGCGAAGGCGGAG GCGGATCTGGCGGCGGAGGATCTCGTACGGTGGCTGCA CCATCTGTCTTCATCTTCCCGCCATCTGATCGGAAGTTGA AATCTGGAACTGCCTCTGTTGTGTGCCTGCTGAATAACT TCTATCCCAGAGAGGCCAAAGTACAGTGGAAGGTGGAT AACGCCCTCCAATCGGGTAACTCCCAGGAGAGTGTCAC AGAGCAGGACAGCAAGGACAGCACCTACAGCCTCAGCA GCACCCTGACGCTGAGCAAAGCAGACTACGAGAAACAC AAAGTCTACGCCTGCGAAGTCACCCATCAGGGCCTGAG CTCGCCCGTCACAAAGAGCTTCAACAGGGGAGAGTGT |
| 68 | anti-FAP (28H1) Fc hole chain | see Table 2 |
| 69 | anti-FAP (28H1) light chain | see Table 2 |
| 111 | Dimeric hu 4-1BBL (52-254)-CH1* Fc knob chain | PWAVSGARASPGSAASPRLREGPELSPDDPAGLLDLRQGM FAQLVAQNVLLIDGPLSWYSDPGLAGVSLTGGLSYKEDTK ELVVAKAGVYYVFFQLELRRVVAGEGSGSVSLALHLQPLR SAAGAAALALTVDLPPASSEARNSAFGFQGRLLHLSAGQR LGVHLHTEARARHAWQLTQGATVLGLFRVTPEIPAGLPSP RSEGGGGSGGGGSPWAVSGARASPGSAASPRLREGPELSP DDPAGLLDLRQGMFAQLVAQNVLLIDGPLSWYSDPGLAG VSLTGGLSYKEDTKELVVAKAGVYYVFFQLELRRVVAGE GSGSVSLALHLQPLRSAAGAAALALTVDLPPASSEARNSAF GFQGRLLHLSAGQRLGVHLHTEARARHAWQLTQGATVLG LFRVTPEIPAGLPSPRSEGGGGSGGGGSASTKGPSVFPLAPS SKSTSGGTAALGCLVEDYFPEPVTVSWNSGALTSGVHTFP AVLQSSGLYSLSSVVTVPSSSLGTQTYICNVNHKPSNTKVD EKVEPKSCDKTHTCPPCPAPEAAGGPSVFLFPPKPKDTLMI SRTPEVTCVVVDVSHEDPEVKFNWYVDGVEVHNAKTKPR EEQYNSTYRVVSVLTVLHQDWLNGKEYKCKVSNKALGAP IEKTISKAKGQPREPQVYTLPPCRDELTKNQVSLWCLVKGF YPSDIAVEWESNGQPENNYKTTPPVLDSDGSFFLYSKLTVD KSRWQQGNVFSCSVMHEALHNHYTQKSLSLSPGK |
| 112 | Monomeric hu 4-1BBL (52-254)-CL* | PWAVSGARASPGSAASPRLREGPELSPDDPAGLLDLRQGM FAQLVAQNVLLIDGPLSWYSDPGLAGVSLTGGLSYKEDTK ELVVAKAGVYYVFFQLELRRVVAGEGSGSVSLALHLQPLR SAAGAAALALTVDLPPASSEARNSAFGFQGRLLHLSAGQR LGVHLHTEARARHAWQLTQGATVLGLFRVTPEIPAGLPSP RSEGGGGSGGGGSRTVAAPSVFIFPPSDRKLKSGTASVVCL LNNFYPREAKVQWKVDNALQSGNSQESVTEQDSKDSTYS LSSTLTLSKADYEKHKVYACEVTHQGLSSPVTKSFNRGEC |
| 18 | anti-FAP (28H1) Fc hole chain | see Table 2 |
| 19 | anti-FAP (28H1) light chain | see Table 2 |

Figure 2J:
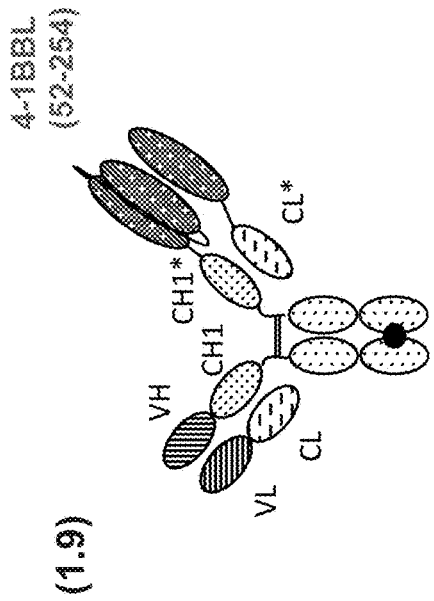

Table 11 shows the cDNA and amino acid sequences of the monovalent FAP-targeted 4-1BB ligand (80-254) trimer-containing Fc (kih) fusion molecule Construct 1.10 (FIG. 2J) (FAP split trimer with 4-1BBL ectodomain amino acids 80-254 and charged residues on ligand chains).

TABLE 11

Sequences of FAP-targeted human 4-1BB ligand trimer
containing Fc (kih) fusion molecule Construct 10

| SEQ ID NO: | Description | Sequence |
|---|---|---|
| 152 | Dimeric hu 4-1BBL (80-254)-CH1* Fc knob chain | GATCCTGCCGGCCTGCTGGATCTGCGGCAGGGAATGTTT<br>GCCCAGCTGGTGGCCCAGAACGTGCTGCTGATCGATGG<br>CCCCCTGAGCTGGTACAGCGATCCTGGACTGGCTGGCGT<br>GTCACTGACAGGCGGCCTGAGCTACAAAGAGGACACCA<br>AAGAACTGGTGGTGGCCAAGGCCGGCGTGTACTACGTG<br>TTCTTTCAGCTGGAACTGCGGAGAGTGGTGGCCGGCGAA<br>GGATCTGGCTCTGTGTCTCTGGCCCTGCATCTGCAGCCC<br>CTGAGAAGCGCTGCTGGCGCTGCAGCTCTGGCACTGAC<br>AGTGGATCTGCCTCCTGCCAGCTCCGAGGCCCGGAATAG<br>CGCATTTGGGTTTCAAGGCAGACTGCTGCACCTGTCTGC<br>CGGCCAGAGGCTGGGAGTGCATCTGCACACAGAGGCCA<br>GGGCTAGACACGCCTGGCAGCTGACACAGGGCGCTACA<br>GTGCTGGGCCTGTTCAGAGTGACCCCCGAGATTCCAGCC<br>GGACTGCCCAGCCCTAGATCTGAAGGCGGCGGAGGAAG<br>CGGAGGCGGAGGATCCGACCCAGCTGGACTGCTGGACC<br>TGCGGCAGGGAATGTTCGCTCAGCTGGTGGCTCAGAATG<br>TGCTGCTGATTGACGGACCTCTGTCCTGGTACTCCGACC<br>CTGGCCTGGCAGGGGTGTCCCTGACTGGGGGACTGTCCT<br>ACAAAGAAGATACAAAGAACTGGTGGTGGCTAAAGCT<br>GGGGTGTACTATGTGTTTTTTCAGCTGGAACTGAGGCGG<br>GTGGTGGCTGGGGAGGGCTCAGGATCTGTGTCCCTGGCT<br>CTGCATCTGCAGCCTCTGCGCTCTGCTGCTGGCGCAGCT<br>GCACTGGCTCTGACTGTGGACCTGCCACCAGCCTCTAGC<br>GAGGCCAGAAACAGCGCCTTCGGGTTCCAAGGACGGCT<br>GCTGCATCTGAGCGCCGGACAGCGCCTGGGAGTGCATC<br>TGCATACTGAAGCCAGAGCCCGGCATGCTTGGCAGCTG<br>ACCCAGGGGGCAACTGTGCTGGGACTGTTTCGCGTGACA<br>CCTGAGATCCCCGCTGGCCTGCCTAGCCCAAGAAGTGA<br>AGGGGGAGGCGGATCTGGCGGAGGGGATCTGCTAGCA<br>CCAAGGGCCCCTCCGTGTTCCCCCTGGCCCCCAGCAGCA<br>AGAGCACCAGCGGCGGCACAGCCGCTCTGGGCTGCCTG<br>GTCGAGGACTACTTCCCCGAGCCCGTGACCGTGTCCTGG<br>AACAGCGGAGCCCTGACCTCCGGCGTGCACACCTTCCCC<br>GCCGTGCTGCAGAGTTCTGGCCTGTATAGCCTGAGCAGC<br>GTGGTCACCGTGCCTTCTAGCAGCCTGGGCACCCAGACC<br>TACATCTGCAACGTGAACCACAAGCCCAGCAACACCAA<br>GGTGGACGAGAAGGTGGAGCCCAAGAGCTGCGACAAAA<br>CTCACACATGCCCACCGTGCCCAGCACCTGAAGCTGCAG<br>GGGGACCGTCAGTCTTCCTCTTCCCCCCAAAACCCAAGG<br>ACACCCTCATGATCTCCCGGACCCCTGAGGTCACATGCG<br>TGGTGGTGGACGTGAGCCACGAAGACCCTGAGGTCAAG<br>TTCAACTGGTACGTGGACGGCGTGGAGGTGCATAATGCC<br>AAGACAAAGCCGCGGGAGGAGCAGTACAACAGCACGT<br>ACCGTGTGGTCAGCGTCCTCACCGTCCTGCACCAGGACT<br>GGCTGAATGGCAAGGAGTACAAGTGCAAGGTCTCCAAC<br>AAAGCCCTCGGCGCCCCCATCGAGAAAACCATCTCCAA<br>AGCCAAAGGGCAGCCCCGAGAACCACAGGTGTACACCC<br>TGCCCCCATGCCGGGATGAGCTGACCAAGAACCAGGTC<br>AGCCTGTGGTGCCTGGTCAAAGGCTTCTATCCCAGCGAC<br>ATCGCCGTGGAGTGGGAGAGCAATGGGCAGCCGGAGAA<br>CAACTACAAGACCACGCCTCCCGTGCTGGACTCCGACG<br>GCTCCTTCTTCCTCTACAGCAAGCTCACCGTGGACAAGA<br>GCAGGTGGCAGCAGGGGAACGTCTTCTCATGCTCCGTGA<br>TGCATGAGGCTCTGCACAACCACTACACGCAGAAGAGC<br>CTCTCCCTGTCTCCGGGTAAA |
| 153 | Monomeric hu 4-1BBL (80-254)-CL* | GATCCTGCCGGCCTGCTGGATCTGCGGCAGGGAATGTTT<br>GCCCAGCTGGTGGCCCAGAACGTGCTGCTGATCGATGG<br>CCCCCTGAGCTGGTACAGCGATCCTGGACTGGCTGGCGT<br>GTCACTGACAGGCGGCCTGAGCTACAAAGAGGACACCA<br>AAGAACTGGTGGTGGCCAAGGCCGGCGTGTACTACGTG<br>TTCTTTCAGCTGGAACTGCGGAGAGTGGTGGCCGGCGAA<br>GGATCTGGCTCTGTGTCTCTGGCCCTGCATCTGCAGCCC<br>CTGAGAAGCGCTGCTGGCGCTGCAGCTCTGGCACTGAC<br>AGTGGATCTGCCTCCTGCCAGCTCCGAGGCCCGGAATAG<br>CGCATTTGGGTTTCAAGGCAGGCTGCTGCACCTGTCTGC<br>CGGCCAGAGGCTGGGAGTGCATCTGCACACAGAGGCCA<br>GGGCTAGACACGCCTGGCAGCTGACACAGGGCGCTACA<br>GTGCTGGGCCTGTTCAGAGTGACCCCCGAGATTCCAGCC<br>GGCCTGCCTTCTCCAAGAAGCGAAGGCGGAGGCGGATC<br>TGGCGGCGAGGATCTCGTACGGTGGCTGCACCATCTGT<br>CTTCATCTTCCCGCCATCTGATCGGAAGTTGAAATCTGG<br>AACTGCCTCTGTTGTGTGCCTGCTGAATAACTTCTATCCC<br>AGAGAGGCCAAAGTACAGTGGAAGGTGGATAACGCCCT |

TABLE 11-continued

Sequences of FAP-targeted human 4-1BB ligand trimer containing Fc (kih) fusion molecule Construct 10

| SEQ ID NO: | Description | Sequence |
|---|---|---|
| | | CCAATCGGGTAACTCCCAGGAGAGTGTCACAGAGCAGG ACAGCAAGGACAGCCACCTACAGCCTCAGCAGCACCCTG ACGCTGAGCAAAGCAGACTACGAGAAACACAAAGTCTA CGCCTGCGAAGTCACCCATCAGGGCCTGAGCTCGCCCGT CACAAAGAGCTTCAACAGGGGAGAGTGT |
| 68 | anti-FAP (28H1) Fc hole chain | see Table 2 |
| 69 | anti-FAP (28H1) light chain | see Table 2 |
| 113 | Dimeric hu 4-1BBL (80-254)-CH1* Fc knob chain | DPAGLLDLRQGMFAQLVAQNVLLIDGPLSWYSDPGLAGV SLTGGLSYKEDTKELVVAKAGVYYVFFQLELRRVVAGEGS GSVSLALHLQPLRSAAGAAALALTVDLPPASSEARNSAFGF QGRLLHLSAGQRLGVHLHTEARARHAWQLTQGATVLGLF RVTPEIPAGLPSPRSEGGGGSGGGGSDPAGLLDLRQGMFA QLVAQNVLLIDGPLSWYSDPGLAGVSLTGGLSYKEDTKEL VVAKAGVYYVFFQLELRRVVAGEGSGSVSLALHLQPLRSA AGAAALALTVDLPPASSEARNSAFGFQGRLLHLSAGQRLG VHLHTEARARHAWQLTQGATVLGLFRVTPEIPAGLPSPRSE GGGGSGGGGSASTKGPSVFPLAPSSKSTSGGTAALGCLVE DYFPEPVTVSWNSGALTSGVHTFPAVLQSSGLYSLSSVVTV PSSSLGTQTYICNVNHKPSNTKVDEKVEPKSCDKTHTCPPC PAPEAAGGPSVFLFPPKPKDTLMISRTPEVTCVVVDVSHED PEVKFNWYVDGVEVHNAKTKPREEQYNSTYRVVSVLTVL HQDWLNGKEYKCKVSNKALGAPIEKTISKAKGQPREPQVY TLPPCRDELTKNQVSLWCLVKGFYPSDIAVEWESNGQPEN NYKTTPPVLDSDGSFFLYSKLTVDKSRWQQGNVFSCSVMH EALHNHYTQKSLSLSPGK |
| 114 | Monomeric hu 4-1BBL (80-254)-CL* | DPAGLLDLRQGMFAQLVAQNVLLIDGPLSWYSDPGLAGV SLTGGLSYKEDTKELVVAKAGVYYVFFQLELRRVVAGEGS GSVSLALHLQPLRSAAGAAALALTVDLPPASSEARNSAFGF QGRLLHLSAGQRLGVHLHTEARARHAWQLTQGATVLGLF RVTPEIPAGLPSPRSEGGGGSGGGGSRTVAAPSVFIFPPSDR KLKSGTASVVCLLNNFYPREAKVQWKVDNALQSGNSQES VTEQDSKDSTYSLSSTLTLSKADYEKHKVYACEVTHQGLS SPVTKSFNRGEC |
| 18 | anti-FAP (28H1) Fc hole chain | see Table 2 |
| 19 | anti-FAP (28H1) light chain | see Table 2 |

1.2 Production of FAP (28H1) Targeted Split Trimeric 4-1BB Ligand Fc Fusion Constructs The targeted TNF ligand trimer-containing Fc (kih) fusion antigen binding molecule encoding sequences were cloned into a plasmid vector, which drives expression of the insert from an MPSV promoter and contains a synthetic polyA sequence located at the 3' end of the CDS. In addition, the vector contains an EBV OriP sequence for episomal maintenance of the plasmid.

The targeted TNF ligand trimer-containing Fc (kih) fusion antigen binding molecule was produced by co-transfecting HEK293-EBNA cells with the mammalian expression vectors using polyethylenimine. The cells were transfected with the corresponding expression vectors at a 1:1:1:1 ratio (e.g. "vector dimeric ligand-(CH1 or CL)-knob chain":"vector monomeric ligand fusion-(CL or CH1)":"vector anti-FAP Fab-hole heavy chain":"vector anti-FAP light chain") for the Constructs 1, 2, 3, 4, 6, 7, 8, 9, 10. For the bivalent Construct 5, a 1:1:1 ratio ("vector hole heavy chain":"vector knob heavy chain":"vector anti-FAP light chain") was used.

For production in 500 mL shake flasks, 300 million HEK293 EBNA cells were seeded 24 hours before transfection. For transfection cells were centrifuged for 10 minutes at 210×g, and the supernatant was replaced by 20 mL pre-warmed CD CHO medium. Expression vectors (200 μg of total DNA) were mixed in 20 mL CD CHO medium. After addition of 540 μL PEI, the solution was vortexed for 15 seconds and incubated for 10 minutes at room temperature. Afterwards, cells were mixed with the DNA/PEI solution, transferred to a 500 mL shake flask and incubated for 3 hours at 37° C. in an incubator with a 5% $CO_2$ atmosphere. After the incubation, 160 mL of Excell medium supplemented with 6 mM L-Glutamine, 5 g/L PEPSOY and 1.2 mM valproic acid was added and cells were cultured for 24 hours. One day after transfection 12% Feed 7 and Glucose (final concentration 3 g/L) were added. After culturing for 7 days, the supernatant was collected by centrifugation for 30-40 minutes at 400×g. The solution was sterile filtered (0.22 μm filter), supplemented with sodium azide to a final concentration of 0.01% (w/v), and kept at 4° C.

The targeted TNF ligand trimer-containing Fc (kih) fusion antigen binding molecule was purified from cell culture supernatants by affinity chromatography using Protein A, followed by size exclusion chromatography. For affinity chromatography, the supernatant was loaded on a MABSE-LECT SURE® column (CV=5-15 mL, resin from GE Healthcare) equilibrated with 20 mM sodium phosphate, 20 mM sodium citrate buffer (pH 7.5). Unbound protein was removed by washing with at least 6 column volumes of the same buffer. The bound protein was eluted using either a linear gradient (20 CV) or a step elution (8 CV) with 20 mM sodium citrate, 100 mM Sodium chloride, 100 mM Glycine buffer (pH 3.0). For the linear gradient an additional 4 column volumes step elution was applied.

The pH of collected fractions was adjusted by adding 1/10 (v/v) of 0.5M sodium phosphate, pH 8.0. The protein was concentrated prior to loading on a HILOAD® Superdex 200 column (GE Healthcare) equilibrated with 20 mM Histidine, 140 mM sodium chloride, 0.01% (v/v) TWEEN® 20 (polysorbate 20) solution of pH 6.0.

The protein concentration was determined by measuring the optical density (OD) at 280 nm, using a molar extinction coefficient calculated on the basis of the amino acid sequence. Purity and molecular weight of the targeted TNF ligand trimer-containing Fc (kih) fusion antigen binding molecule was analyzed by SDS-PAGE in the presence and absence of a reducing agent (5 mM 1,4-dithiotreitol) and staining with Coomassie SIMPLYBLUE™ SafeStain (Invitrogen USA) or or CE-SDS using Caliper LabChip GXII (Perkin Elmer). The aggregate content of samples was analyzed using a TSKGEL® G3000 SW XL analytical size-exclusion column (Tosoh) equilibrated in 25 mM $K_2HPO_4$, 125 mM NaCl, 200 mM L-Arginine Monohydrocloride, 0.02% (w/v) $NaN_3$, pH 6.7 running buffer at 25° C.

Table 12 summarizes the yield and final monomer content of the FAP-targeted 4-1BBL trimer-containing Fc (kih) fusion antigen binding molecules.

TABLE 12

Biochemical Analysis of the FAP (28H1)-targeted 4-1BBL trimer-containing Fc (kih) fusion antigen binding molecules

| Construct | Yield [mg/l] | Monomer [%] (SEC) |
|---|---|---|
| Construct 1.1 | 12.7 | 95 |
| Construct 1.2 | 25.2 | 97 |
| Construct 1.3 | 22 | 92 |
| Construct 1.4 | 14.2 | 99 |
| Construct 1.5 | 14 | 99 |
| Construct 1.6 | 12 | 98 |

TABLE 12-continued

Biochemical Analysis of the FAP (28H1)-targeted 4-1BBL trimer-containing Fc (kih) fusion antigen binding molecules

| Construct | Yield [mg/l] | Monomer [%] (SEC) |
|---|---|---|
| Construct 1.7 | 3.4 | 99 |
| Construct 1.8 | 5.4 | 98 |
| Construct 1.9 | 11.2 | 98 |
| Construct 1.10 | 19.8 | 99 |

1.3 Preparation of Targeted Murine 4-1BB Ligand Trimer-Containing Fc Fusion Antigen Binding Molecules Similarly to targeted human 4-1BB ligand trimer-containing Fc fusion antigen binding molecules, murine FAP-targeted 4-1BBL trimer-containing Fc fusion antigen binding molecules were prepared.

The DNA sequence encoding part of the ectodomain (amino acids 104-309) of murine 4-1BB ligand was synthesized according to the Q3U1Z9-1 sequence of Uniprot database (SEQ ID NO:70). For Construct M.1 the cysteines at positions 137, 160 and 246 were mutated to Serine by standard PCR methods, whereas for Construct M.2 the cysteine at position 160 was mutated to Serine (C160S).

Figure 3A:
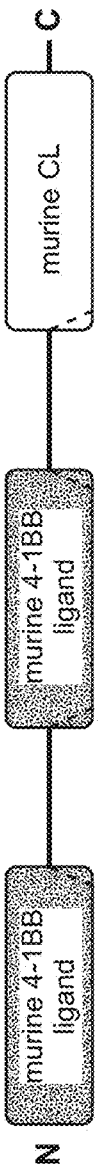
FIGS. 3A to 3C show the components for the assembly of split trimeric murine 4-1BB ligands including linker GGGGSGGGGS (SEQ ID NO:13).
Figure 3B:
Figure 3C:
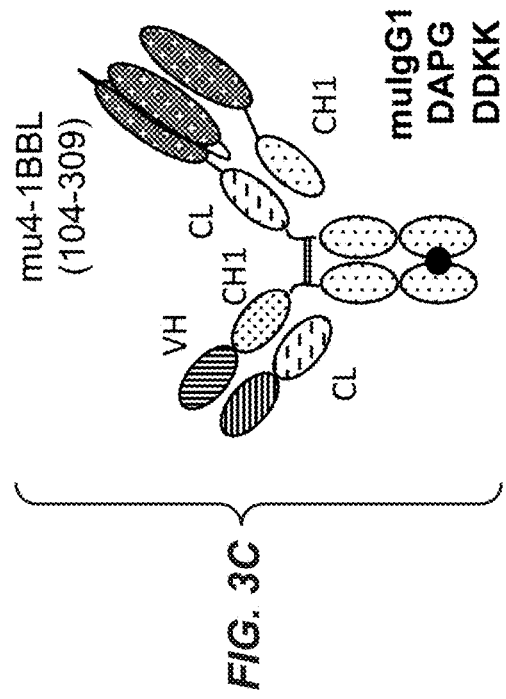

The murine ligand was assembled as described for the human 4-1BBL and as depicted in FIGS. 3A and 3B. The dimeric 4-1BBL, separated by $(G_4S)_2$ (SEQ ID NO:13) linkers, was fused to the murine IgG1-CL domain (FIG. 3A) and the monomeric 4-1BBL was fused to murine IgG1-CH domain (FIG. 3B). The polypeptide encoding the dimeric 4-1BB ligand fused to murine CL domain was subcloned in frame with the murine IgG1 heavy chain CH2 and CH3 domains to build the Constructs as depicted in FIG. 3C.

For the murine constructs, mutations Lys392Asp and Lys409Asp (DD) were introduced in the heavy chain containing the murine 4-1BBL and mutations Glu356Lys and Asp399Lys (KK) were introduced in the heavy chain containing the anti-FAP Fab to obtain asymmetric molecules (Gunasekaran K. et al, J Biol. Chem., 2010, Jun. 18; 285(25):19637-46).

Mutations Asp265Ala and Pro329Gly (DAPG) were introduced in the constant region of the heavy chains to abrogate binding to Fc gamma receptors.

Table 13 shows, respectively, the cDNA and amino acid sequences of the FAP-targeted murine 4-1BB ligand trimer-containing Fc fusion antigen binding molecule Construct M.1.

TABLE 13

Sequences of FAP-targeted murine Construct M.1

| SEQ ID NO: | Description | Sequence |
|---|---|---|
| 71 | Dimeric murine 4-1BBL (104-309, C137, 160, 246S)-CL Fc DD chain | AGAACCGAGCCCAGACCCGCCCTGACCATCACCACCAG CCCTAACCTGGGCACCAGAGAGAACAACGCCGACCAAG TGACCCCCGTGTCCCACATCGGCAGCCCCAATACCACAC AGCAGGGCAGCCCTGTGTTCGCCAAGCTGCTGGCCAAG AACCAGGCCAGCCTGAGCAACACCACCCTGAACTGGCA CAGCCAGGATGGCGCCGGAAGCAGCTATCTGAGCCAGG GCCTGAGATACGAAGAGGACAAGAAAGAACTGGTGGTG GACAGCCCTGGCCTGTACTACGTGTTCCTGGAACTGAAG CTGAGCCCCACCTTCACCAACACCGGCCACAAGGTGCA GGGCTGGGTGTCACTGGTGCTGCAGGCCAAACCCCAGG TGGACGACTTCGACAACCTGGCCCTGACCGTGGAACTGT TCCCCAGCAGCATGGAAAACAAGCTGGTGGATCGGAGC TGGTCCCAGCTTCTGCTGCTGAAGGCCGGACACAGACTG AGCGTGGGCTGAGGGCTTATCTGCACGGCGCCCAGGA CGCCTACAGAGACTGGGAGCTGAGCTACCCCAACACAA |

TABLE 13-continued

Sequences of FAP-targeted murine Construct M.1

| SEQ ID NO: | Description | Sequence |
|---|---|---|
| | | CCAGCTTCGGCCTGTTCCTCGTGAAGCCCGACAACCCTT<br>GGGAAGGCGGCGGAGGATCTGGCGGAGGCGGATCTAGA<br>ACAGAGCCTCGGCCTGCCCTGACAATTACCACATCCCCC<br>AATCTGGGCACCCGGGAAAACAATGCAGATCAAGTGAC<br>ACCTGTGTCTCATATTGGCTCCCCAAACACTACCCAGCA<br>GGGCTCCCCCGTGTTTGCTAAACTGCTGGCTAAAAATCA<br>GGCCTCCCTGTCTAACACAACACTGAACTGGCACTCCCA<br>GGACGGCGCTGGCAGCTCTTACCTGAGTCAGGGACTGC<br>GCTATGAGGAAGATAAGAAAGAACTGGTGGTGGATTCC<br>CCCGGACTGTACTATGTGTTTCTGGAACTGAAACTGTCC<br>CCTACCTTTACAAATACCGGGCACAAAGTGCAGGGATG<br>GGTGTCCCTGGTGCTGCAGGCTAAGCCTCAGGTGGACGA<br>TTTTGATAATCTGGCTCTGACAGTGGAACTGTTTCCTAG<br>CAGCATGGAAAACAAGCTGGTGGACAGAAGCTGGTCCC<br>AGCTCCTGCTGCTGAAGGCCGGACACAGACTGAGCGTG<br>GGCCTGAGAGCCTATCTGCACGGCGCCCAGGACGCCTA<br>CAGAGACTGGGAGCTGAGCTACCCCAACACAACCAGCT<br>TCGGCCTGTTCCTCGTGAAGCCCGACAACCCTTGGGAAG<br>GCGGCGGAGGATCTGGCGGAGGCGGATCCAGAGCTGAT<br>GCTGCCCCTACCGTGTCCATCTTCCCACCCAGCAGCGAG<br>CAGCTGACATCTGGGGGAGCTAGCGTCGTGTGCTTCCTG<br>AACAACTTCTACCCCAAGGACATCAACGTGAAGTGGAA<br>GATCGACGGCAGCGAGCGGCAGAACGGCGTGCTGAATA<br>GCTGGACCGACCAGGACAGCAAGGACTCCACCTACAGC<br>ATGAGCAGCACCCTGACCCTGACCAAGGACGAGTACGA<br>GCGGCACAACAGCTACACATGCGAGGCCACCCACAAGA<br>CCAGCACCAGCCCCATCGTGAAGTCCTTCAACCGGAAC<br>GAGTGCGTGCCCAGAGACTGCGGCTGCAAGCCTTGCAT<br>CTGCACCGTGCCTGAGGTGTCCAGCGTGTTCATCTTCCC<br>ACCCAAGCCCAAGGACGTGCTGACCATCACCCTGACAC<br>CCAAAGTGACCTGCGTGGTGGTGGCCATCAGCAAGGAT<br>GACCCCGAGGTGCAGTTCAGTTGGTTCGTGGACGACGTG<br>GAAGTGCACACCGCTCAGACCAAGCCCAGAGAGGAACA<br>GATCAACAGCACCTTCAGAAGCGTGTCCGAGCTGCCCAT<br>CATGCACCAGGACTGGCTGAACGGCAAAGAATTCAAGT<br>GCAGAGTGAACAGCGCCGCCTTTGGCGCCCCTATCGAG<br>AAAACCATCTCCAAGACCAAGGGCAGACCCAAGGCCCC<br>CCAGGTGTACACAATCCCCCCACCCAAAGAACAGATGG<br>CCAAGGACAAGGTGTCCCTGACCTGCATGATCACCAATT<br>TCTTCCCAGAGGATATCACCGTGGAATGGCAGTGGAAC<br>GGCCAGCCCGCCGAGAACTACGACAACACCCAGCCTAT<br>CATGGACACCGACGGCTCCTACTTCGTGTACAGCGACCT<br>GAACGTGCAGAAGTCCAACTGGGAGGCCGGCAACACCT<br>TCACCTGTAGCGTGCTGCACGAGGGCCTGCACAACCACC<br>ACACCGAGAAGTCCCTGTCCCACAGCCCTGGCAAG |
| 72 | Monomeric murine 4-1BBL (104-309, C137, 160, 246S)-CL | AGAACCGAGCCCAGACCCGCCCTGACCATCACCACCAG<br>CCCTAACCTGGGCACCAGAGAGAACAACGCCGACCAAG<br>TGACCCCCGTGTCCCACATCGGCAGCCCCAATACCACAC<br>AGCAGGGCAGCCCTGTGTTCGCCAAGCTGCTGGCCAAG<br>AACCAGGCCAGCCTGAGCAACACCACCCTGAACTGGCA<br>CAGCCAGGATGGCGCCGGAAGCAGCTATCTGAGCCAGG<br>GCCTGAGATACGAAGAGGACAAGAAAGAACTGGTGGTG<br>GACAGCCCTGGCCTGTACTACGTGTTCCTGGAACTGAAG<br>CTGAGCCCCACCTTCACCAACACCGGCCACAAGGTGCA<br>GGGCTGGGTGTCACTGGTGCTGCAGGCCAAACCCCAGG<br>TGGACGACTTCGACAACCTGGCCCTGACCGTGGAACTGT<br>TCCCCAGCAGCATGGAAAACAAGCTGGTGGATCGGAGC<br>TGGTCCCAGCTTCTGCTGCTGAAGGCCGGACACAGACTG<br>AGCGTGGGCCTGAGGGCCTATCTGCATGGCGCCCAGGA<br>CGCCTACAGAGACTGGGAGCTGAGCTACCCCAACACAA<br>CCAGCTTCGGCCTGTTCCTCGTGAAGCCCGACAACCCTT<br>GGGAAGGCGGCGGAGGCTCCGGAGGAGGCGGAAGCGC<br>TAAGACCACCCCCCCCAGCGTGTACCCTCTGGCCCCTGG<br>ATCTGCCGCCCAGACCAACAGCATGGTGACCCTGGGCT<br>GCCTGGTGAAGGGCTACTTCCCCGAGCCTGTGACCGTGA<br>CCTGGAACAGCGGCAGCCTGAGCAGCGGCGTGCACACC<br>TTTCCAGCCGTGCTGCAGAGCGACCTGTACACCCTGAGC<br>AGCTCCGTGACCGTGCCTAGCAGCACCTGGCCCAGCCA<br>GACAGTGACCTGCAACGTGGCCCACCCTGCCAGCAGCA<br>CCAAGGTGGACAAGAAAATCGTGCCCCGGGACTGC |
| 73 | anti-FAP (28H1) Fc KK heavy chain | GAAGTGCAGCTGCTGGAATCCGGCGGAGGCCTGGTGCA<br>GCCTGGCGGATCTCTGAGACTGTCCTGCGCCGCCTCCGG<br>CTTCACCTTCTCCTCCCACGCCATGTCCTGGGTCCGACA |

TABLE 13-continued

Sequences of FAP-targeted murine Construct M.1

| SEQ ID NO: | Description | Sequence |
|---|---|---|
| | | GGCTCCTGGCAAAGGCCTGGAATGGGTGTCCGCCATCTG<br>GGCCTCCGGCGAGCAGTACTACGCCGACTCTGTGAAGG<br>GCCGGTTCACCATCTCCCGGGACAACTCCAAGAACACCC<br>TGTACCTGCAGATGAACTCCCTGCGGGCCGAGGACACC<br>GCCGTGTACTACTGTGCCAAGGGCTGGCTGGGCAACTTC<br>GACTACTGGGGACAGGGCACCCTGGTCACCGTGTCCAG<br>CGCTAAGACCACCCCCCCTAGCGTGTACCCTCTGGCCCC<br>TGGATCTGCCGCCCAGACCAACAGCATGGTGACCCTGG<br>GCTGCCTGGTGAAGGGCTACTTCCCCGAGCCTGTGACCG<br>TGACCTGGAACAGCGGCAGCCTGAGCAGCGGCGTGCAC<br>ACCTTTCCAGCCGTGCTGCAGAGCGACCTGTACACCCTG<br>AGCAGCTCCGTGACCGTGCCTAGCAGCACCTGGCCCAG<br>CCAGACAGTGACCTGCAACGTGGCCCACCCTGCCAGCA<br>GCACCAAGGTGGACAAGAAAATCGTGCCCCGGGACTGC<br>GGCTGCAAGCCCTGCATCTGCACCGTGCCCGAGGTGTCC<br>AGCGTGTTCATCTTCCCACCCAAGCCCAAGGACGTGCTG<br>ACCATCACCCTGACCCCCAAAGTGACCTGCGTGGTGGTG<br>GCCATCAGCAAGGACGACCCCGAGGTGCAGTTCTCTTG<br>GTTTGTGGACGACGTGGAGGTGCACACAGCCCAGACAA<br>AGCCCCGGGAGGAACAGATCAACAGCACCTTCAGAAGC<br>GTGTCCGAGCTGCCCATCATGCACCAGGACTGGCTGAAC<br>GGCAAAGAATTCAAGTGCAGAGTGAACAGCGCCGCCTT<br>CGGCGCCCCCATCGAGAAAACCATCAGCAAGACCAAGG<br>GCAGACCCAAGGCCCCCCAGGTGTACACCATCCCCCCA<br>CCCAAAAAACAGATGGCCAAGGACAAGGTGTCCCTGAC<br>CTGCATGATCACCAACTTTTTCCCCGAGGACATCACCGT<br>GGAGTGGCAGTGGAATGGCCAGCCCGCCGAGAACTACA<br>AGAACACCCAGCCCATCATGAAGACCGACGGCAGCTAC<br>TTCGTGTACAGCAAGCTGAACGTGCAGAAGTCCAACTG<br>GGAGGCCGGCAACACCTTCACCTGTAGCGTGCTGCACG<br>AGGGCCTGCACAACCACCACACCGAGAAGTCCCTGAGC<br>CACTCCCCCGGCAAG |
| 74 | anti-FAP (28H1) light chain | GAGATCGTGCTGACCCAGTCCCCCGGCACCCTGTCTCTG<br>AGCCCTGGCGAGAGAGCCACCCTGTCCTGCAGAGCCTC<br>CCAGTCCGTGTCCCGGTCCTACCTCGCCTGGTATCAGCA<br>GAAGCCCGGCCAGGCCCCTCGGCTGCTGATCATCGGCG<br>CCTCTACCAGAGCCACCGGCATCCCTGACCGGTTCTCCG<br>GCTCTGGCTCCGGCACCGACTTCACCCTGACCATCTCCC<br>GGCTGGAACCCGAGGACTTCGCCGTGTACTACTGCCAGC<br>AGGGCCAGGTCATCCCTCCCACCTTTGGCCAGGGCACCA<br>AGGTGGAAATCAAGCGTGCCGATGCTGCACCAACTGTA<br>TCGATTTTCCCACCATCCAGTGAGCAGTTAACATCTGGA<br>GGTGCCTCAGTCGTGTGCTTCTTGAACAACTTCTACCCC<br>AAAGACATCAATGTCAAGTGGAAGATTGATGGCAGTGA<br>ACGACAAAATGGCGTCCTGAACAGTTGGACTGATCAGG<br>ACAGCAAAGACAGCACCTACAGCATGAGCAGCACCCTC<br>ACGTTGACCAAGGACGAGTATGAACGACATAACAGCTA<br>TACCTGTGAGGCCACTCACAAGACATCAACTTCACCCAT<br>TGTCAAGAGCTTCAACAGGAATGAGTGT |
| 75 | Dimeric murine 4-1BBL (104-309, C137, 160, 246S)- CL Fc DD chain | RTEPRPALTITTSPNLGTRENNADQVTPVSHIGSPNTTQQGS<br>PVFAKLLAKNQASLSNTTLNWHSQDGAGSSYLSQGLRYEE<br>DKKELVVDSPGLYYVFLELKLSPTFTNTGHKVQGWVSLVL<br>QAKPQVDDFDNLALTVELFPSSMENKLVDRSWSQLLLLKA<br>GHRLSVGLRAYLHGAQDAYRDWELSYPNTTSFGLFLVKP<br>DNPWEGGGGSGGGGSRTEPRPALTITTSPNLGTRENNADQ<br>VTPVSHIGSPNTTQQGSPVFAKLLAKNQASLSNTTLNWHS<br>QDGAGSSYLSQGLRYEEDKKELVVDSPGLYYVFLELKLSP<br>TFTNTGHKVQGWVSLVLQAKPQVDDFDNLALTVELFPSS<br>MENKLVDRSWSQLLLLKAGHRLSVGLRAYLHGAQDAYR<br>DWELSYPNTTSFGLFLVKPDNPWEGGGGSGGGGSRADAA<br>PTVSIFPPSSEQLTSGGASVVCFLNNFYPKDINVKWKIDGSE<br>RQNGVLNSWTDQDSKDSTYSMSSTLTLTKDEYERHNSYT<br>CEATHKTSTSPIVKSFNRNECVPRDCGCKPCICTVPEVSSVF<br>IFPPKPKDVLTITLTPKVTCVVVAISKDDPEVQFSWFVDDV<br>EVHTAQTKPREEQINSTFRSVSELPIMHQDWLNGKEFKCR<br>VNSAAFGAPIEKTISKTKGRPKAPQVYTIPPPKEQMAKDKV<br>SLTCMITNFFPEDITVEWQWNGQPAENYDNTQPIMDTDGS<br>YFVYSDLNVQKSNWEAGNTFTCSVLHEGLHNHHTEKSLS<br>HSPGK |
| 76 | Monomeric murine 4-1BBL (104-309, | RTEPRPALTITTSPNLGTRENNADQVTPVSHIGSPNTTQQGS<br>PVFAKLLAKNQASLSNTTLNWHSQDGAGSSYLSQGLRYEE<br>DKKELVVDSPGLYYVFLELKLSPTFTNTGHKVQGWVSLVL |

TABLE 13-continued

Sequences of FAP-targeted murine Construct M.1

| SEQ ID NO: | Description | Sequence |
|---|---|---|
|  | C137, 160, 246S)-CL | QAKPQVDDFDNLALTVELFPSSMENKLVDRSWSQLLLLKA GHRLSVGLRAYLHGAQDAYRDWELSYPNTTSFGLFLVKP DNPWEGGGGSGGGGSAKTTPPSVYPLAPGSAAQTNSMVT LGCLVKGYFPEPVTVTWNSGSLSSGVHTFPAVLQSDLYTL SSSVTVPSSTWPSQTVTCNVAHPASSTKVDKKIVPRDC |
| 77 | anti-FAP (28H1) Fc KK chain | EVQLLESGGGLVQPGGSLRLSCAASGFTFSSHAMSWVRQA PGKGLEWVSAIWASGEQYYADSVKGRFTISRDNSKNTLYL QMNSLRAEDTAVYYCAKGWLGNFDYWGQGTLVTVSSAK TTPPSVYPLAPGSAAQTNSMVTLGCLVKGYFPEPVTVTWN SGSLSSGVHTFPAVLQSDLYTLSSSVTVPSSTWPSQTVTCN VAHPASSTKVDKKIVPRDCGCKPCICTVPEVSSVFIFPPKPK DVLTITLTPKVTCVVVAISKDDPEVQFSWFVDDVEVHTAQ TKPREEQINSTFRSVSELPIMHQDWLNGKEFKCRVNSAAFG APIEKTISKTKGRPKAPQVYTIPPPKKQMAKDKVSLTCMIT NFFPEDITVEWQWNGQPAENYKNTQPIMKTDGSYFVYSKL NVQKSNWEAGNTFTCSVLHEGLHNHHTEKSLSHSPGK |
| 78 | anti-FAP (28H1) light chain | EIVLTQSPGTLSLSPGERATLSCRASQSVSRSYLAWYQQKP GQAPRLLIIGASTRATGIPDRFSGSGSGTDFTLTISRLEPEDF AVYYCQQGQVIPPTFGQGTKVEIKRADAAPTVSIFPPSSEQ LTSGGASVVCFLNNFYPKDINVKWKIDGSERQNGVLNSWT DQDSKDSTYSMSSTLTLTKDEYERHNSYTCEATHKTSTSPI VKSFNRNEC |

Table 14 shows, respectively, the cDNA and amino acid sequences of the untargeted (DP47) murine 4-1 BB ligand trimer-containing Fc fusion antigen binding molecule Control M.1.

TABLE 14

Sequences of untargeted murine Control M.1

| SEQ ID NO: | Description | Sequence |
|---|---|---|
| 71 | Dimeric murine 4-1BBL (104-309, C137, 160, 246S)-CL Fc DD chain | See Table 13 |
| 72 | Monomeric murine 4-1BBL (104-309, C137, 160, 246S)-CH1 | See Table 13 |
| 154 | DP47 Fc KK chain | GAGGTGCAATTGTTGGAGTCTGGGGGAGGCTTGGTACA GCCTGGGGGGTCCCTGAGACTCTCCTGTGCAGCCTCCGG ATTCACCTTTAGCAGTTATGCCATGAGCTGGGTCCGCCA GGCTCCAGGGAAGGGGCTGGAGTGGGTCTCAGCTATTA GTGGTAGTGGTGGTAGCACATACTACGCAGACTCCGTGA AGGGCCGGTTCACCATCTCCAGAGACAATTCCAAGAAC ACGCTGTATCTGCAGATGAACAGCCTGAGAGCCGAGGA CACGGCCGTATATTACTGTGCGAAAGGCAGCGGATTTGA CTACTGGGGCCAAGGAACCCTGGTCACCGTCTCGAGCG CTAAGACCACCCCCCCTAGCGTGTACCCTCTGGCCCCTG GATCTGCCGCCCAGACCAACAGCATGGTGACCCTGGGC TGCCTGGTGAAGGGCTACTTCCCCGAGCCTGTGACCGTG ACCTGGAACAGCGGCAGCCTGAGCAGCGGCGTGCACAC CTTTCCAGCCGTGCTGCAGAGCGACCTGTACACCCTGAG CAGCTCCGTGACCGTGCCTAGCAGCACCTGGCCCAGCCA GACAGTGACCTGCAACGTGGCCCACCCTGCCAGCAGCA CCAAGGTGGACAAGAAAATCGTGCCCCGGGACTGCGGC TGCAAGCCCTGCATCTGCACCGTGCCCGAGGTGTCCAGC GTGTTCATCTTCCCACCCAAGCCCAAGGACGTGCTGACC ATCACCCTGACCCCCAAAGTGACCTGCGTGGTGGTGGCC ATCAGCAAGGACGACCCCGAGGTGCAGTTCTCTTGGTTT GTGGACGACGTGGAGGTGCACACAGCCCAGACAAAGCC CCGGGAGGAACAGATCAACAGCACCTTCAGAAGCGTGT CCGAGCTGCCCATCATGCACCAGGACTGGCTGAACGGC |

TABLE 14-continued

Sequences of untargeted murine Control M.1

| SEQ ID NO: | Description | Sequence |
|---|---|---|
| | | AAAGAATTCAAGTGCAGAGTGAACAGCGCCGCCTTCGG<br>CGCCCCCATCGAGAAAACCATCAGCAAGACCAAGGGCA<br>GACCCAAGGCCCCCCAGGTGTACACCATCCCCCCACCCA<br>AAAAACAGATGGCCAAGGACAAGGTGTCCCTGACCTGC<br>ATGATCACCAACTTTTTCCCCGAGGACATCACCGTGGAG<br>TGGCAGTGGAATGGCCAGCCCGCCGAGAACTACAAGAA<br>CACCCAGCCCATCATGAAGACCGACGGCAGCTACTTCGT<br>GTACAGCAAGCTGAACGTGCAGAAGTCCAACTGGGAGG<br>CCGGCAACACCTTCACCTGTAGCGTGCTGCACGAGGGCC<br>TGCACAACCACCACACCGAGAAGTCCCTGAGCCACTCC<br>CCCGGCAAG |
| 155 | DP47 light chain | GAAATCGTGTTAACGCAGTCTCCAGGCACCCTGTCTTTG<br>TCTCCAGGGGAAAGAGCCACCCTCTCTTGCAGGGCCAGT<br>CAGAGTGTTAGCAGCAGCTACTTAGCCTGGTACCAGCAG<br>AAACCTGGCCAGGCTCCCAGGCTCCTCATCTATGGAGCA<br>TCCAGCAGGGCCACTGGCATCCCAGACAGGTTCAGTGG<br>CAGTGGATCCGGGACAGACTTCACTCTCACCATCAGCAG<br>ACTGGAGCCTGAAGATTTTGCAGTGTATTACTGTCAGCA<br>GTATGGTAGCTCACCGCTGACGTTCGGCCAGGGGACCA<br>AAGTGGAAATCAAACGTGCCGATGCTGCACCAACTGTA<br>TCGATTTTCCCACCATCCAGTGAGCAGTTAACATCTGGA<br>GGTGCCTCAGTCGTGTGCTTCTTGAACAACTTCTACCCC<br>AAAGACATCAATGTCAAGTGGAAGATTGATGGCAGTGA<br>ACGACAAAATGGCGTCCTGAACAGTTGGACTGATCAGG<br>ACAGCAAAGACAGCACCTACAGCATGAGCAGCACCCTC<br>ACGTTGACCAAGGACGAGTATGAACGACATAACAGCTA<br>TACCTGTGAGGCCACTCACAAGACATCAACTTCACCCAT<br>TGTCAAGAGCTTCAACAGGAATGAGTGT |
| 75 | Dimeric murine 4-1BBL (104-309, C137, 160, 246S)- CL Fc DD chain | see Table 13 |
| 76 | Monomeric murine 4-1BBL (104-309, C137, 160, 246S)- CH1 | See Table 13 |
| 156 | DP47 Fc KK chain | EVQLLESGGGLVQPGGSLRLSCAASGFTFSSYAMSWVRQA<br>PGKGLEWVSAISGSGGSTYYADSVKGRFTISRDNSKNTLYL<br>QMNSLRAEDTAVYYCAKGSGFDYWGQGTLVTVSSAKTTP<br>PSVYPLAPGSAAQTNSMVTLGCLVKGYFPEPVTVTWNSGS<br>LSSGVHTFPAVLQSDLYTLSSSVTVPSSTWPSQTVTCNVAH<br>PASSTKVDKKIVPRDCGCKPCICTVPEVSSVFIFPPKPKDVL<br>TITLTPKVTCVVVAISKDDPEVQFSWFVDDVEVHTAQTKP<br>REEQINSTFRSVSELPIMHQDWLNGKEFKCRVNSAAFGAPI<br>EKTISKTKGRPKAPQVYTIPPPKKQMAKDKVSLTCMITNFF<br>PEDITVEWQWNGQPAENYKNTQPIMKTDGSYFVYSKLNV<br>QKSNWEAGNTFTCSVLHEGLHNHHTEKSLSHSPGK |
| 157 | DP47 light chain | EIVLTQSPGTLSLSPGERATLSCRASQSVSSSYLAWYQQKP<br>GQAPRLLIYGASSRATGIPDRFSGSGSGTDFTLTISRLEPEDF<br>AVYYCQQYGSSPLTFGQGTKVEIKRADAAPTVSIFPPSSEQ<br>LTSGGASVVCFLNNFYPKDINVKWKIDGSERQNGVLNSWT<br>DQDSKDSTYSMSSTLTLTKDEYERHNSYTCEATHKTSTSPI<br>VKSFNRNEC |

Table 15 shows the cDNA and amino acid sequences of the FAP-targeted murine 4-1BB ligand trimer-containing Fc fusion antigen binding molecule Construct M.2.

TABLE 15

Sequences of FAP-targeted murine Construct M.2

| SEQ ID NO: | Description | Sequence |
|---|---|---|
| 158 | Dimeric murine 4-1BBL (104-309, C160S)- CL Fc DD chain | AGAACCGAGCCCAGACCCGCCCTGACCATCACCACCAG CCCTAACCTGGGCACCAGAGAGAACAACGCCGACCAAG TGACCCCCGTGTCCCACATCGGCTGCCCCAATACCACAC AGCAGGGCAGCCCTGTGTTCGCCAAGCTGCTGGCCAAG AACCAGGCCAGCCTGAGCAACACCACCCTGAACTGGCA CAGCCAGGATGGCGCCGGAAGCAGCTATCTGAGCCAGG GCCTGAGATACGAAGAGGACAAGAAAGAACTGGTGGTG GACAGCCCTGGCCTGTACTACGTGTTCCTGGAACTGAAG CTGAGCCCCACCTTCACCAACACCGGCCACAAGGTGCA GGGCTGGGTGTCACTGGTGCTGCAGGCCAAACCCCAGG TGGACGACTTCGACAACCTGGCCCTGACCGTGGAACTGT TCCCCTGCAGCATGGAAAACAAGCTGGTGGATCGGAGC TGGTCCCAGCTTCTGCTGCTGAAGGCCGGACACAGACTG AGCGTGGGCCTGAGGGCTTATCTGCACGGCGCCCAGGA CGCCTACAGAGACTGGGAGCTGAGCTACCCCAACACAA CCAGCTTCGGCCTGTTCCTCGTGAAGCCCGACAACCCTT GGGAAGGCGGCGGAGGCTCCGGAGGAGGCGGATCTAGA ACAGAGCCTCGGCCTGCCCTGACAATTACCACATCCCCC AATCTGGGCACCCGGGAAAACAATGCAGATCAAGTGAC ACCTGTGTCTCATATTGGGTGCCCAACACTACCCAGCA GGGGTCCCCAGTGTTTGCTAAACTGCTGGCTAAAAATCA GGCCTCCCTGTCTAACACAACACTGAATTGGCATAGTCA GGACGGGGCTGGCAGCAGCTACCTGTCTCAGGGACTGC GCTATGAGGAAGATAAGAAAGAACTGGTGGTGGATTCC CCCGGACTGTACTATGTGTTTCTGGAACTGAAACTGTCC CCTACCTTTACAAATACCGGGCACAAAGTGCAGGGATG GGTGTCCCTGGTGCTGCAGGCTAAGCCTCAGGTGGACGA TTTTGATAATCTGGCTCTGACAGTGGAACTGTTTCCTTGC TCTATGGAAAACAAACTGGTGGACCGCTCTTGGAGCCA GTTGCTGCTGCTGAAAGCTGGCCACCGGCTGTCTGTGGG ACTGAGAGCATACCTGCATGGGGCACAGGATGCCTACC GGGATTGGGAACTGTCCTACCCTAACACTACTTCCTTCG GACTGTTCCTCGTGAAACCTGATAATCCCTGGGAGGGCG GAGGCGGAAGTGGCGGAGGGGGATCCAGAGCTGATGCT GCCCCTACCGTGTCCATCTTCCCACCCAGCAGCGAGCAG CTGACATCTGGGGGAGCTAGCGTCGTGTGCTTCCTGAAC AACTTCTACCCCAAGGACATCAACGTGAAGTGGAAGAT CGACGGCAGCGAGCGGCAGAACGGCGTGCTGAATAGCT GGACCGACCAGGACAGCAAGGACTCCACCTACAGCATG AGCAGCACCCTGACCCTGACCAAGGACGAGTACGAGCG GCACAACAGCTACACATGCGAGGCCACCCACAAGACCA GCACCAGCCCCATCGTGAAGTCCTTCAACCGGAACGAG TGCGTGCCCAGAGACTGCGGCTGCAAGCCTTGCATCTGC ACCGTGCCTGAGGTGTCCAGCGTGTTCATCTTCCCACCC AAGCCCAAGGACGTGCTGACCATCACCCTGACACCCAA AGTGACCTGCGTGGTGGTGGCCATCAGCAAGGATGACC CCGAGGTGCAGTTCAGTTGGTTCGTGGACGACGTGGAA GTGCACACCGCTCAGACCAAGCCCAGAGAGGAACAGAT CAACAGCACCTTCAGAAGCGTGTCCGAGCTGCCCATCAT GCACCAGGACTGGCTGAACGGCAAAGAATTCAAGTGCA GAGTGAACAGCGCCGCCTTTGGCGCCCCTATCGAGAAA ACCATCTCCAAGACCAAGGGCAGACCCAAGGCCCCCCA GGTGTACACAATCCCCCCACCCAAAGAACAGATGGCCA AGGACAAGGTGTCCCTGACCTGCATGATCACCAATTTCT TCCCAGAGGATATCACCGTGGAATGGCAGTGGAACGGC CAGCCCGCCGAGAACTACGACAACACCCAGCCTATCAT GGACACCGACGGCTCCTACTTCGTGTACAGCGACCTGAA CGTGCAGAAGTCCAACTGGGAGGCCGGCAACACCTTCA CCTGTAGCGTGCTGCACGAGGGCCTGCACAACCACCAC ACCGAGAAGTCCCTGTCCCACAGCCCTGGCAAG |
| 159 | Monomeric murine 4-1BBL (104-309, C160S)- CH1 | AGAACCGAGCCCAGACCCGCCCTGACCATCACCACCAG CCCTAACCTGGGCACCAGAGAGAACAACGCCGACCAAG TGACCCCCGTGTCCCACATCGGCTGCCCCAATACCACAC AGCAGGGCAGCCCTGTGTTCGCCAAGCTGCTGGCCAAG AACCAGGCCAGCCTGAGCAACACCACCCTGAACTGGCA CAGCCAGGATGGCGCCGGAAGCAGCTATCTGAGCCAGG GCCTGAGATACGAAGAGGACAAGAAAGAACTGGTGGTG GACAGCCCTGGCCTGTACTACGTGTTCCTGGAACTGAAG CTGAGCCCCACCTTCACCAACACCGGCCACAAGGTGCA |

TABLE 15-continued

Sequences of FAP-targeted murine Construct M.2

| SEQ ID NO: | Description | Sequence |
|---|---|---|
| | | GGGCTGGGTGTCACTGGTGCTGCAGGCCAAACCCCAGG
TGGACGACTTCGACAACCTGGCCCTGACCGTGGAACTGT
TCCCCTGCAGCATGGAAAACAAGCTGGTGGATCGGAGC
TGGTCCCAGCTTCTGCTGCTGAAGGCCGGACACAGACTG
AGCGTGGGCCTGAGGGCTTATCTGCACGGCGCCCAGGA
CGCCTACAGAGACTGGGAGCTGAGCTACCCCAACACAA
CCAGCTTCGGCCTGTTCCTCGTGAAGCCCGACAACCCTT
GGGAAGGCGGCGGAGGCTCCGGAGGAGGCGGAAGCGC
TAAGACCACCCCCCCCAGCGTGTACCCTCTGGCCCCTGG
ATCTGCCGCCCAGACCAACAGCATGGTGACCCTGGGCT
GCCTGGTGAAGGGCTACTTCCCCGAGCCTGTGACCGTGA
CCTGGAACAGCGGCAGCCTGAGCAGCGGCGTGCACACC
TTTCCAGCCGTGCTGCAGAGCGACCTGTACACCCTGAGC
AGCTCCGTGACCGTGCCTAGCAGCACCTGGCCCAGCCA
GACAGTGACCTGCAACGTGGCCCACCCTGCCAGCAGCA
CCAAGGTGGACAAGAAAATCGTGCCCCGGGACTGC |
| 73 | anti-FAP (28H1) Fc KK chain | see Table 13 |
| 74 | anti-FAP (28H1) light chain | see Table 13 |
| 160 | Dimeric murine 4-1BBL (104-309, C160S)- CL Fc DD chain | RTEPRPALTITTSPNLGTRENNADQVTPVSHIGCPNTTQQGS
PVFAKLLAKNQASLSNTTLNWHSQDGAGSSYLSQGLRYEE
DKKELVVDSPGLYYVFLELKLSPTFTNTGHKVQGWVSLVL
QAKPQVDDFDNLALTVELFPCSMENKLVDRSWSQLLLLK
AGHRLSVGLRAYLHGAQDAYRDWELSYPNTTSFGLFLVK
PDNPWEGGGGSGGGGSRTEPRPALTITTSPNLGTRENNAD
QVTPVSHIGCPNTTQQGSPVFAKLLAKNQASLSNTTLNWH
SQDGAGSSYLSQGLRYEEDKKELVVDSPGLYYVFLELKLS
PTFTNTGHKVQGWVSLVLQAKPQVDDFDNLALTVELFPCS
MENKLVDRSWSQLLLLKAGHRLSVGLRAYLHGAQDAYR
DWELSYPNTTSFGLFLVKPDNPWEGGGGSGGGGSRADAA
PTVSIFPPSSEQLTSGGASVVCFLNNFYPKDINVKWKIDGSE
RQNGVLNSWTDQDSKDSTYSMSSTLTLTKDEYERHNSYT
CEATHKTSTSPIVKSFNRNECVPRDCGCKPCICTVPEVSSVF
IFPPKPKDVLTITLTPKVTCVVVAISKDDPEVQFSWFVDDV
EVHTAQTKPREEQINSTFRSVSELPIMHQDWLNGKEFKCR
VNSAAFGAPIEKTISKTKGRPKAPQVYTIPPPKEQMAKDKV
SLTCMITNFFPEDITVEWQWNGQPAENYDNTQPIMDTDGS
YFVYSDLNVQKSNWEAGNTFTCSVLHEGLHNHHTEKSLS
HSPGK |
| 161 | Monomeric murine 4-1BBL (104-309, C160S)- CH1 | RTEPRPALTITTSPNLGTRENNADQVTPVSHIGCPNTTQQGS
PVFAKLLAKNQASLSNTTLNWHSQDGAGSSYLSQGLRYEE
DKKELVVDSPGLYYVFLELKLSPTFTNTGHKVQGWVSLVL
QAKPQVDDFDNLALTVELFPCSMENKLVDRSWSQLLLLK
AGHRLSVGLRAYLHGAQDAYRDWELSYPNTTSFGLFLVK
PDNPWEGGGGSGGGGSAKTTPPSVYPLAPGSAAQTNSMV
TLGCLVKGYFPEPVTVTWNSGSLSSGVHTFPAVLQSDLYT
LSSSVTVPSSTWPSQTVTCNVAHPASSTKVDKKIVPRDC |
| 77 | anti-FAP (28H1) Fc KK chain | see Table 13 |
| 78 | anti-FAP (28H1) light chain | see Table 13 |

Table 16 shows the cDNA and amino acid sequences of the DP47-untargeted murine 4-1BB ligand trimer-containing Fc fusion antigen binding molecule Construct Control M.2.

TABLE 16

Sequences of FAP-targeted murine Control M.2

| SEQ ID NO: | Description | Sequence |
|---|---|---|
| 158 | Dimeric mu 4-1BBL (104-309, C160S) - CL Fc DD chain | see Table 15 |
| 159 | Monomeric mu 4-1BBL (104-309, C160S) - CH1 | see Table 15 |
| 154 | DP47 Fc KK chain | see Table 14 |
| 155 | DP47 light chain | see Table 14 |
| 160 | Dimeric mu 4-1BBL (104-309, C160S) - CL Fc DD chain | see Table 15 |
| 161 | Monomeric mu 4-1BBL (104-309, C160S) - CH1 | see Table 15 |
| 156 | DP47 Fc KK chain | see Table 14 |
| 157 | DP47 light chain | see Table 14 |

The murine 4-1BB ligand trimer-containing Fc fusion antigen binding molecules were produced and purified as described herein before for the human 4-1BBL constructs.

Table 17 summarizes the yield and final monomer content of the FAP-targeted and untargeted murine 4-1BBL trimer-containing Fc fusion antigen binding molecule.

TABLE 17

Summary of the production of the FAP-targeted and untargeted murine 4-1BBL trimer-containing Fc fusion antigen binding molecules

| Construct | Yield [mg/l] | Monomer [%] (SEC) |
|---|---|---|
| Construct M.1 | 2.6 | 95 |
| Control M.2 | 2.3 | 96 |
| Construct M.2 | 8.5 | 98 |
| Control M.2 | 8.1 | 97 |

1.4 Preparation and Purification of Untargeted Human 4-1BB Ligand Trimer-Containing Fc Fusion Antigen Binding Molecules (Control Molecules)

Figure 5B:
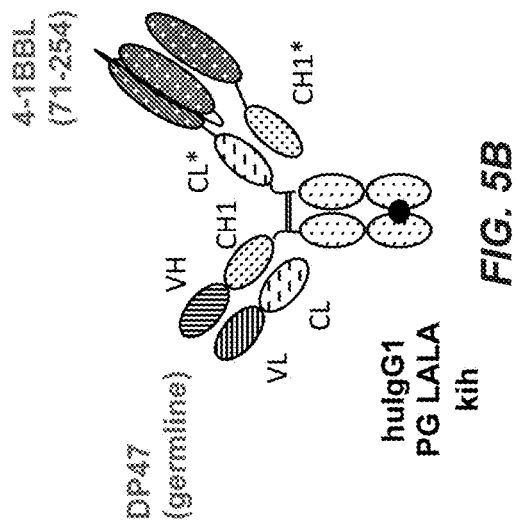
FIG. 5A and FIG. 5B show the "untargeted" variants of Constructs 1.1 and 1.2 comprising a DP47 Fab molecule instead of the anti-FAP Fab molecule. The molecules are named Control A and Control B, respectively. The preparation is described in Example 1.4.
Figure 5A:
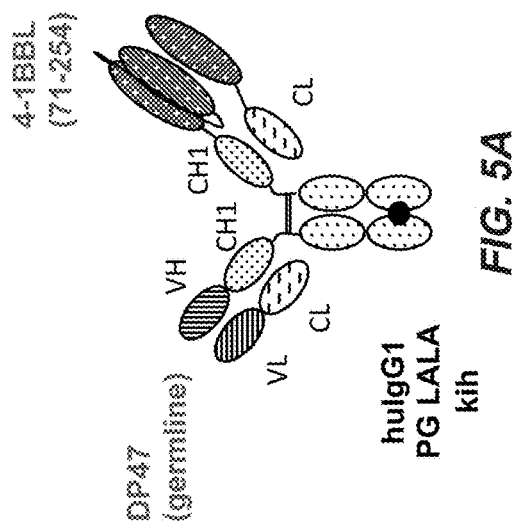

The control molecules were prepared as described above for the FAP-targeted Constructs 1 and 2, with the only difference that the anti-FAP binder (VH-VL) was replaced by a germline control, termed DP47, not binding to the antigen. The control is an untargeted monovalent split trimeric human 4-1BB ligand Fc (kih) (Control A, FIG. 5A) and for Control B, the construct also contains a CH-CL crossover with charged residues (FIG. 5B). The variable region of heavy and light chain DNA sequences of the FAP binder were replaced with those of the germline control (DP47) and subcloned in frame with either the constant heavy chain of the hole or the constant light chain of human IgG1.

The untargeted 4-1BB ligand trimer-containing Fc (kih) fusion antigen binding molecules were produced as described above for the FAP-targeted constructs. The cells were transfected with the corresponding expression vectors at a 1:1:1:1 ratio ("vector dimeric ligand-CH1 or CL*-knob chain":"vector monomeric ligand fusion-CL or CH1*": "vector DP47 Fab-hole chain":"vector DP47 light chain").

Table 18 shows, respectively, the cDNA and amino acid sequences of the DP47-untargeted 4-1BB ligand trimer-containing Fc (kih) fusion antigen binding molecule Control A.

TABLE 18

Sequences of DP47 untargeted 4-1BB ligand trimer-containing Fc (kih) fusion antigen binding molecule (DP47 split 4-1BBL trimer) Control A

| SEQ ID NO: | Description | Sequence |
|---|---|---|
| 66 | Dimeric hu 4-1BBL (71-254)- CH1 Fc knob chain | See Table 2 |
| 67 | Monomeric hu 4-1BBL (71-254)- CL | see Table 2 |
| 79 | DP47 Fc hole chain | GAGGTGCAATTGTTGGAGTCTGGGGGAGGCTTGGTACA GCCTGGGGGGTCCCTGAGACTCTCCTGTGCAGCCTCCGG ATTCACCTTTAGCAGTTATGCCATGAGCTGGGTCCGCCA GGCTCCAGGGAAGGGGCTGGAGTGGGTCTCAGCTATTA GTGGTAGTGGTGGTAGCACATACTACGCAGACTCCGTGA AGGGCCGGTTCACCATCTCCAGAGACAATTCCAAGAAC ACGCTGTATCTGCAGATGAACAGCCTGAGAGCCGAGGA CACGGCCGTATATTACTGTGCGAAAGGCAGCGGATTTGA CTACTGGGGCCAAGGAACCCTGGTCACCGTCTCGAGTGC TAGCACCAAGGGCCCATCGGTCTTCCCCCTGGCACCCTC CTCCAAGAGCACCTCTGGGGGCACAGCGGCCCTGGGCT GCCTGGTCAAGGACTACTTCCCCGAACCGGTGACGGTGT CGTGGAACTCAGGCGCCCTGACCAGCGGCGTGCACACC TTCCCGGCTGTCCTACAGTCCTCAGGACTCTACTCCCTC AGCAGCGTGGTGACCGTGCCCTCCAGCAGCTTGGGCAC CCAGACCTACATCTGCAACGTGAATCACAAGCCCAGCA |

TABLE 18-continued

Sequences of DP47 untargeted 4-1BB ligand trimer-containing Fc (kih) fusion antigen binding molecule (DP47 split 4-1BBL trimer) Control A

| SEQ ID NO: | Description | Sequence |
|---|---|---|
| | | ACACCAAGGTGGACAAGAAAGTTGAGCCCAAATCTTGT GACAAAACTCACACATGCCCACCGTGCCCAGCACCTGA AGCTGCAGGGGACCGTCAGTCTTCCTCTTCCCCCCAAA ACCCAAGGACACCCTCATGATCTCCCGGACCCCTGAGGT CACATGCGTGGTGGTGGACGTGAGCCACGAAGACCCTG AGGTCAAGTTCAACTGGTACGTGGACGGCGTGGAGGTG CATAATGCCAAGACAAAGCCGCGGGAGGAGCAGTACAA CAGCACGTACCGTGTGGTCAGCGTCCTCACCGTCCTGCA CCAGGACTGGCTGAATGGCAAGGAGTACAAGTGCAAGG TCTCCAACAAAGCCCTCGGCGCCCCCATCGAGAAAACC ATCTCCAAAGCCAAAGGGCAGCCCCGAGAACCACAGGT GTGCACCCTGCCCCCATCCCGGGATGAGCTGACCAAGA ACCAGGTCAGCCTCTCGTGCGCAGTCAAAGGCTTCTATC CCAGCGACATCGCCGTGGAGTGGGAGAGCAATGGGCAG CCGGAGAACAACTACAAGACCACGCCTCCCGTGCTGGA CTCCGACGGCTCCTTCTTCCTCGTGAGCAAGCTCACCGT GGACAAGAGCAGGTGGCAGCAGGGGAACGTCTTCTCAT GCTCCGTGATGCATGAGGCTCTGCACAACCACTACACGC AGAAGAGCCTCTCCCTGTCTCCGGGTAAA |
| 80 | DP47 light chain | GAAATCGTGTTAACGCAGTCTCCAGGCACCCTGTCTTTG TCTCCAGGGGAAAGAGCCACCCTCTCTTGCAGGGCCAGT CAGAGTGTTAGCAGCAGCTACTTAGCCTGGTACCAGCAG AAACCTGGCCAGGCTCCCAGGCTCCTCATCTATGGAGCA TCCAGCAGGGCCACTGGCATCCCAGACAGGTTCAGTGG CAGTGGATCCGGGACAGACTTCACTCTCACCATCAGCAG ACTGGAGCCTGAAGATTTTGCAGTGTATTACTGTCAGCA GTATGGTAGCTCACCGCTGACGTTCGGCCAGGGGACCA AGGTGGAAATCAAACGTACGGTGGCTGCACCATCTGTCT TCATCTTCCCGCCATCTGATGAGCAGTTGAAATCTGGAA CTGCCTCTGTTGTGTGCCTGCTGAATAACTTCTATCCCAG AGAGGCCAAAGTACAGTGGAAGGTGGATAACGCCCTCC AATCGGGTAACTCCCAGGAGAGTGTCACAGAGCAGGAC AGCAAGGACAGCACCTACAGCCTCAGCAGCACCCTGAC GCTGAGCAAAGCAGACTACGAGAAACACAAAGTCTACG CCTGCGAAGTCACCCATCAGGGCCTGAGCTCGCCCGTCA CAAAGAGCTTCAACAGGGGAGAGTGT |
| 14 | Dimeric hu 4-1BBL (71-254)-CH1 Fc knob chain | See Table 2 |
| 15 | Monomeric hu 4-1BBL (71-254)-CL | See Table 2 |
| 81 | DP47 Fc hole chain | EVQLLESGGGLVQPGGSLRLSCAASGFTFSSYAMSWVRQA PGKGLEWVSAISGSGGSTYYADSVKGRFTISRDNSKNTLYL QMNSLRAEDTAVYYCAKGSGFDYWGQGTLVTVSSASTKG PSVFPLAPSSKSTSGGTAALGCLVKDYFPEPVTVSWNSGAL TSGVHTFPAVLQSSGLYSLSSVVTVPSSSLGTQTYICNVNH KPSNTKVDKKVEPKSCDKTHTCPPCPAPEAAGGPSVFLFPP KPKDTLMISRTPEVTCVVVDVSHEDPEVKFNWYVDGVEV HNAKTKPREEQYNSTYRVVSVLTVLHQDWLNGKEYKCKV SNKALGAPIEKTISKAKGQPREPQVCTLPPSRDELTKNQVS LSCAVKGFYPSDIAVEWESNGQPENNYKTTPPVLDSDGSFF LVSKLTVDKSRWQQGNVFSCSVMHEALHNHYTQKSLSLS PGK |
| 82 | DP47 light chain | EIVLTQSPGTLSLSPGERATLSCRASQSVSSSYLAWYQQKP GQAPRLLIYGASSRATGIPDRFSGSGSGTDFTLTISRLEPEDF AVYYCQQYGSSPLTFGQGTKVEIKRTVAAPSVFIFPPSDEQ LKSGTASVVCLLNNFYPREAKVQWKVDNALQSGNSQESV TEQDSKDSTYSLSSTLTLSKADYEKHKVYACEVTHQGLSS PVTKSFNRGEC |

Table 19 shows the cDNA and amino acid sequences of the DP47-untargeted 4-1BB ligand trimer-containing Fc (kih) fusion antigen binding molecule with CH1-CL crossover and charged residues in the 4-1BB ligand containing arms (Control B).

TABLE 19

Sequences of DP47 untargeted 4-1BB ligand trimer-containing Fc (kih) fusion antigen binding molecule (DP47 split 4-1BBL trimer) Control B

| SEQ ID NO: | Description | Sequence |
|---|---|---|
| 96 | Dimeric hu 4-1BBL (71-254) - CL* Fc knob chain | see Table 3 |
| 97 | Monomeric hu 4-1BBL (71-254) - CH1* | see Table 3 |
| 79 | DP47 Fc hole chain | see Table 18 |
| 80 | DP47 light chain | see Table 18 |
| 98 | Dimeric hu 4-1BBL (71-254) - CL* Fc knob chain | see Table 3 |
| 99 | Monomeric hu 4-1BBL (71-254) - CH1* | see Table 3 |
| 81 | DP47 Fc hole chain | see Table 18 |
| 82 | DP47 light chain | see Table 18 |

Table 20 summarizes the yield and final monomer content of the DP47 untargeted 4-1BB ligand trimer-containing Fc (kih) fusion antigen binding molecules.

TABLE 20

Production Characteristics of DP47 untargeted 4-1BBL trimer-containing Fc (kih) fusion antigen binding molecules (Control molecules)

| Construct | Monomer [%] (SEC) | Yield [mg/l] | LC/MS (non red) |
|---|---|---|---|
| Control A | 97 | 3.7 | Theoretical*: 179069.7 Da Experimental: 179116.2 Da * without terminal lysines |
| Control B | 99 | 15.4 | |

Example 2

2.1 Preparation of FAP (4B9) Targeted 4-1BB Ligand Trimer-Containing Fc Fusion Antigen Binding Molecules Different fragments of the DNA sequence encoding part of the ectodomain (amino acid 71-254 and 71-248) of human 4-1BB ligand were synthesized according to the P41273 sequence of Uniprot database (SEQ ID NO:42).

2.1.1 Preparation of Monovalent FAP (4B9) Targeted 4-1BB Ligand (71-254) Trimer-Containing Fc (kih) Fusion Antigen Binding Molecule with Crossed CH1-CL Domains with Charged Residues (Construct 2.1)

A polypeptide containing two ectodomains of 4-1BB ligand (71-254), separated by $(G_4S)_2$ (SEQ ID NO:13) linkers, and fused to the human IgG1-CL domain, was cloned as depicted in FIG. 1A: human 4-1BB ligand, $(G_4S)_2$ (SEQ ID NO:13) connector, human 4-1BB ligand, $(G_4S)_2$ (SEQ ID NO:13) connector, human CL.

A polypeptide containing one ectodomain of 4-1BB ligand (71-254) and fused to the human IgG1-CH1 domain, was cloned as described in FIG. 1B: human 4-1BB ligand, $(G_4S)_2$ (SEQ ID NO:13) connector, human CH.

The polypeptide encoding the dimeric 4-1BB ligand fused to human CL domain was subcloned in frame with the human IgG1 heavy chain CH2 and CH3 domains on the knob (Merchant, Zhu et al. 1998) using a linker $(G_4S)_2$ (SEQ ID NO:13), or alternatively, GSPGSSSSGS (SEQ ID NO:57).

To improve correct pairing the following mutations have been introduced in the crossed CH-CL. In the dimeric 4-1BB ligand fused to human CL the mutations E123R and Q124K were introduced. In the monomeric 4-1BB ligand fused to human CH1, the mutations K147E and K213E were cloned into the human CH1 domain.

The variable region of heavy and light chain DNA sequences encoding a binder specific for fibroblast activation protein (FAP), clone 4B9, were subcloned in frame with either the constant heavy chain of the hole or the constant light chain of human IgG1.

The generation and preparation of the FAP binders is described in WO 2012/020006 A2, which is incorporated herein by reference.

The Pro329Gly, Leu234Ala and Leu235Ala mutations have been introduced in the constant region of the knob and hole heavy chains to abrogate binding to Fc gamma receptors according to the method described in International Patent Appl. Publ. No. WO 2012/130831.

For all constructs the knobs into hole heterodimerization technology was used with the the S354C/T366W mutations in the knob chain and the corresponding Y349C/T366S/L368A/Y407V mutations in the hole chain.

Combination of the dimeric ligand-Fc knob chain containing the S354C/T366W mutations, the monomeric CH1 fusion, the targeted anti-FAP-Fc hole chain containing the Y349C/T366S/L368A/Y407V mutations and the anti-FAP light chain allows generation of a heterodimer, which includes an assembled trimeric 4-1BB ligand and a FAP binding Fab (FIG. 4A, Construct 2.1).

Table 21 shows the cDNA and amino acid sequences of the monovalent FAP (4B9)-human 4-1BB ligand (71-254) Fc (kih) fusion antigen binding molecule containing CH1-CL crossover and charged residues (Construct 2.1).

TABLE 21

Sequences of monovalent FAP(4B9)-targeted human 4-1BB ligand (71-254) containing Fc (kih) fusion molecule Construct 2.1

| SEQ ID NO: | Description | Sequence |
|---|---|---|
| 129 | Dimeric hu 4-1BBL (71-254)- CL* Fc knob chain | see Table 3 |

TABLE 21-continued

Sequences of monovalent FAP(4B9)-targeted human 4-1BB
ligand (71-254) containing Fc (kih) fusion molecule
Construct 2.1

| SEQ ID NO: | Description | Sequence |
|---|---|---|
| 130 | Monomeric hu 4-1BBL (71-254)-CH1* | see Table 3 |
| 162 | anti-FAP (4B9) Fc hole chain | GAGGTGCAGCTGCTCGAAAGCGGCGGAGGACTGGTGCA GCCTGGCGGCAGCCTGAGACTGTCTTGCGCCGCCAGCG GCTTCACCTTCAGCAGCTACGCCATGAGCTGGGTCCGCC AGGCCCCTGGCAAGGGACTGGAATGGGTGTCCGCCATC ATCGGCTCTGGCGCCAGCACCTACTACGCCGACAGCGTG AAGGGCCGGTTCACCATCAGCCGGGACAACAGCAAGAA CACCCTGTACCTGCAGATGAACAGCCTGCGGGCCGAGG ACACCGCCGTGTACTACTGCGCCAAGGGATGGTTCGGC GGCTTCAACTACTGGGGACAGGGCACCCTGGTCACAGT GTCCAGCGCTAGCACCAAGGGCCCCTCCGTGTTCCCCCT GGCCCCCAGCAGCAAGAGCACCAGCGGCGGCACAGCCG CTCTGGGCTGCCTGGTCAAGGACTACTTCCCCGAGCCCG TGACCGTGTCCTGGAACAGCGGAGCCCTGACCTCCGGC GTGCACACCTTCCCCGCCGTGCTGCAGAGTTCTGGCCTG TATAGCCTGAGCAGCGTGGTCACCGTGCCTTCTAGCAGC CTGGGCACCCAGACCTACATCTGCAACGTGAACCACAA GCCCAGCAACACCAAGGTGGACAAGAAGGTGGAGCCCA AGAGCTGCGACAAAACTCACACATGCCCACCGTGCCCA GCACCTGAAGCTGCAGGGGGACCGTCAGTCTTCCTCTTC CCCCCAAAACCCAAGGACACCCTCATGATCTCCCGGACC CCTGAGGTCACATGCGTGGTGGACGTGAGCCACGA AGACCCTGAGGTCAAGTTCAACTGGTACGTGGACGGCG TGGAGGTGCATAATGCCAAGACAAAGCCGCGGGAGGAG CAGTACAACAGCACGTACCGTGTGGTCAGCGTCCTCACC GTCCTGCACCAGGACTGGCTGAATGGCAAGGAGTACAA GTGCAAGGTCTCCAACAAAGCCCTCGGCGCCCCCATCG AGAAAACCATCTCCAAAGCCAAAGGGCAGCCCCGAGAA CCACAGGTGTGCACCCTGCCCCCATCCCGGGATGAGCTG ACCAAGAACCAGGTCAGCCTCTCGTGCGCAGTCAAAGG CTTCTATCCCAGCGACATCGCCGTGGAGTGGGAGAGCA ATGGGCAGCCGGAGAACAACTACAAGACCACGCCTCCC GTGCTGGACTCCGACGGCTCCTTCTTCCTCGTGAGCAAG CTCACCGTGGACAAGAGCAGGTGGCAGCAGGGGAACGT CTTCTCATGCTCCGTGATGCATGAGGCTCTGCACAACCA CTACACGCAGAAGAGCCTCTCCCTGTCTCCGGGTAAA |
| 163 | anti-FAP (4B9) light chain | GAGATCGTGCTGACCCAGTCCCCCGGCACCCTGTCTCTG AGCCCTGGCGAGAGAGCCACCCTGTCCTGCAGAGCCTC CCAGTCCGTGACCTCCTCCTACCTCGCCTGGTATCAGCA GAAGCCCGGCCAGGCCCCTCGGCTGCTGATCAACGTGG GCAGTCGGAGAGCCACCGGCATCCCTGACCGGTTCTCCG GCTCTGGCTCCGGCACCGACTTCACCCTGACCATCTCCC GGCTGGAACCCGAGGACTTCGCCGTGTACTACTGCCAGC AGGGCATCATGCTGCCCCCCACCTTTGGCCAGGGCACCA AGGTGGAAATCAAGCGTACGGTGGCTGCACCATCTGTCT TCATCTTCCCGCCATCTGATGAGCAGTTGAAATCTGGAA CTGCCTCTGTTGTGTGCCTGCTGAATAACTTCTATCCCAG AGAGGCCAAAGTACAGTGGAAGGTGGATAACGCCCTCC AATCGGGTAACTCCCAGGAGAGTGTCACAGAGCAGGAC AGCAAGGACAGCACCTACAGCCTCAGCAGCACCCTGAC GCTGAGCAAAGCAGACTACGAGAAACAAAGTCTACG CCTGCGAAGTCACCCATCAGGGCCTGAGCTCGCCCGTCA CAAAGAGCTTCAACAGGGGAGAGTGT |
| 115 | Dimeric hu 4-1BBL (71-254)-CL* Fc knob chain | see Table 3 |
| 116 | Monomeric hu 4-1BBL (71-254)-CH1* | see Table 3 |
| 164 | anti-FAP (4B9) Fc hole chain | EVQLLESGGGLVQPGGSLRLSCAASGFTFSSYAMSWVRQA PGKGLEWVSAIIGSGASTYYADSVKGRFTISRDNSKNTLYL QMNSLRAEDTAVYYCAKGWFGGFNYWGQGTLVTVSSAS TKGPSVFPLAPSSKSTSGGTAALGCLVKDYFPEPVTVSWNS GALTSGVHTFPAVLQSSGLYSLSSVVTVPSSSLGTQTYICN |

TABLE 21-continued

Sequences of monovalent FAP(4B9)-targeted human 4-1BB ligand (71-254) containing Fc (kih) fusion molecule Construct 2.1

| SEQ ID NO: | Description | Sequence |
|---|---|---|
| | | VNHKPSNTKVDKKVEPKSCDKTHTCPPCPAPEAAGGPSVF LFPPKPKDTLMISRTPEVTCVVVDVSHEDPEVKFNWYVDG VEVHNAKTKPREEQYNSTYRVVSVLTVLHQDWLNGKEYK CKVSNKALGAPIEKTISKAKGQPREPQVCTLPPSRDELTKN QVSLSCAVKGFYPSDIAVEWESNGQPENNYKTTPPVLDSD GSFFLVSKLTVDKSRWQQGNVFSCSVMHEALHNHYTQKS LSLSPGK |
| 125 | anti-FAP (4B9) light chain | EIVLTQSPGTLSLSPGERATLSCRASQSVTSSYLAWYQQKP GQAPRLLINVGSRRATGIPDRFSGSGSGTDFTLTISRLEPEDF AVYYCQQGIMLPPTFGQGTKVEIKRTVAAPSVFIFPPSDEQ LKSGTASVVCLLNNFYPREAKVQWKVDNALQSGNSQESV TEQDSKDSTYSLSSTLTLSKADYEKHKVYACEVTHQGLSS PVTKSFNRGEC |

2.1.2 Preparation of Monovalent FAP (4B9) Targeted 4-1BB Ligand (71-254) Trimer-Containing Fc (kih) Fusion Antigen Binding Molecule with Crossed CH1-CL Domains without Charged Residues (Construct 2.2)

A polypeptide containing two ectodomains of 4-1BB ligand (71-254), separated by (G$_4$S)$_2$ (SEQ ID NO:13) linkers, and fused to the human IgG1-CL domain, was cloned as depicted in FIG. 1A: human 4-1BB ligand, (G$_4$S)$_2$ (SEQ ID NO:13) connector, human 4-1BB ligand, (G$_4$S)$_2$ (SEQ ID NO:13) connector, human CL.

A polypeptide containing one ectodomain of 4-1BB ligand (71-254) and fused to the human IgG1-CH1 domain, was cloned as described in FIG. 1B: human 4-1BB ligand, (G$_4$S)$_2$ (SEQ ID NO:13) connector, human CH1.

The polypeptide encoding the dimeric 4-1BB ligand fused to human CL domain was subcloned in frame with the human IgG1 heavy chain CH2 and CH3 domains on the knob (Merchant, Zhu et al. 1998) using a linker (G$_4$S)$_2$ (SEQ ID NO:13) or, alternatively, GSPGSSSSGS (SEQ ID NO:57).

The variable region of heavy and light chain DNA sequences encoding a binder specific for fibroblast activation protein (FAP), clone 4B9, were subcloned in frame with either the constant heavy chain of the hole or the constant light chain of human IgG1.

The Pro329Gly, Leu234Ala and Leu235Ala mutations have been introduced in the constant region of the knob and hole heavy chains to abrogate binding to Fc gamma receptors (WO 2012/130831).

Combination of the dimeric ligand-Fc knob chain containing the S354C/T366W mutations, the monomeric CH1 fusion, the targeted anti-FAP-Fc hole chain containing the Y349C/T366S/L368A/Y407V mutations and the anti-FAP light chain allows generation of a heterodimer, which includes an assembled trimeric 4-1BB ligand and a FAP binding Fab (FIG. 4B, Construct 2.2).

Table 22 shows the cDNA and amino acid sequences of the monovalent FAP (4B9)-human 4-1BB ligand (71-254) Fc (kih) fusion antigen binding molecule containing CH1-CL crossover without charged residues (Construct 2.2).

TABLE 22

Sequences of monovalent FAP(4B9)-targeted human 4-1BB ligand (71-254) containing Fc (kih) fusion molecule Construct 2.2

| SEQ ID NO: | Description | Sequence |
|---|---|---|
| 165 | Dimeric hu 4-1BBL (71-254)-CL Fc knob chain | AGAGAGGGCCCTGAGCTGAGCCCCGATGATCCTGCTGG ACTGCTGGACCTGCGGCAGGGCATGTTTGCTCAGCTGGT GGCCCAGAACGTGCTGCTGATCGATGGCCCCCTGTCCTG GTACAGCGATCCTGGACTGGCTGGCGTGTCACTGACAGG CGGCCTGAGCTACAAAGAGGACACCAAAGAACTGGTGG TGGCCAAGGCCGGCGTGTACTACGTGTTCTTTCAGCTGG AACTGCGGAGAGTGGTGGCCGGCGAAGGATCTGGCTCT GTGTCTCTGGCCCTGCATCTGCAGCCTCTGAGAAGCGCT GCTGGCGCTGCAGCTCTGGCACTGACAGTGGATCTGCCT CCTGCCAGCTCCGAGGCCCGGAATAGCGCATTTGGGTTT CAAGGCAGGCTGCTGCACCTGTCTGCCGGCCAGAGGCT GGGAGTGCATCTGCACACAGAGGCCAGGGCTAGACACG CCTGGCAGCTGACACAGGGCGCTACAGTGCTGGGCCTG TTCAGAGTGACCCCCGAGATTCCAGCCGGCCTGCCTTCT CCAAGAAGCGAAGGCGGAGGCGGATCTGGCGGCGGAG GATCTAGAGAGGGACCCGAACTGTCCCCTGACGATCCA GCCGGGCTGCTGGATCTGAGACAGGGAATGTTCGCCCA GCTGGTGGCTCAGAATGTGCTGCTGATTGACGGACCTCT GAGCTGGTACTCCGACCCAGGGCTGGCAGGGGTGTCCC TGACTGGGGGACTGTCCTACAAAGAAGATACAAAAGAA CTGGTGGTGGCTAAAGCTGGGGTGTACTATGTGTTTTTT |

TABLE 22-continued

Sequences of monovalent FAP(4B9)-targeted human 4-1BB
ligand (71-254) containing Fc (kih) fusion molecule
Construct 2.2

| SEQ ID NO: | Description | Sequence |
|---|---|---|
| | | CAGCTGGAACTGAGGCGGGTGGTGGCTGGGGAGGGCTC AGGATCTGTGTCCCTGGCTCTGCATCTGCAGCCACTGCG CTCTGCTGCTGGCGCAGCTGCACTGGCTCTGACTGTGGA CCTGCCACCAGCCTCTAGCGAGGCCAGAAACAGCGCCT TCGGGTTCCAAGGACGCCTGCTGCATCTGAGCGCCGGAC AGCGCCTGGGAGTGCATCTGCATACTGAAGCCAGAGCC CGGCATGCTTGGCAGCTGACTCAGGGGGCAACTGTGCTG GGACTGTTTCGCGTGACACCTGAGATCCCTGCCGGACTG CCAAGCCCTAGATCAGAAGGGGGCGGAGGTTCCGGAGG GGGAGGATCTCGTACGGTGGCCGCTCCCTCCGTGTTTAT CTTTCCCCCATCCGATGAACAGCTGAAAAGCGGCACCGC CTCCGTCGTGTGTCTGCTGAACAATTTTTACCCTAGGGA AGCTAAAGTGCAGTGGAAAGTGGATAACGCACTGCAGT CCGGCAACTCCCAGGAATCTGTGACAGAACAGGACTCC AAGGACAGCACCTACTCCCTGTCCTCCACCCTGACACTG TCTAAGGCTGATTATGAGAAACACAAAGTCTACGCCTGC GAAGTCACCCATCAGGGCCTGAGCTCGCCCGTCACAAA GAGCTTCAACAGGGGAGAGTGTGACAAGACCCACACCT GTCCCCCTTGTCCTGCCCCTGAAGCTGCTGGCGGCCCTT CTGTGTTCCTGTTCCCCCCAAAGCCCAAGGACACCCTGA TGATCAGCCGGACCCCCGAAGTGACCTGCGTGGTGGTG GATGTGTCCCACGAGGACCCTGAAGTGAAGTTCAATTGG TACGTGGACGGCGTGGAAGTGCACAATGCCAAGACCAA GCCGCGGGAGGAGCAGTACAACAGCACGTACCGTGTGG TCAGCGTCCTCACCGTCCTGCACCAGGACTGGCTGAATG GCAAGGAGTACAAGTGCAAGGTCTCCAACAAAGCCCTC GGCGCCCCCATCGAGAAAACCATCTCCAAAGCCAAGG GCAGCCCCGAGAACCACAGGTGTACACCCTGCCCCCAT GCCGGGATGAGCTGACCAAGAACCAGGTCAGCCTGTGG TGCCTGGTCAAAGGCTTCTATCCCAGCGACATCGCCGTG GAGTGGGAGAGCAATGGGCAGCCGGAGAACAACTACAA GACCACGCCTCCCGTGCTGGACTCCGACGGCTCCTTCTT CCTCTACAGCAAGCTCACCGTGGACAAGAGCAGGTGGC AGCAGGGGAACGTCTTCTCATGCTCCGTGATGCATGAGG CTCTGCACAACCACTACACGCAGAAGAGCCTCTCCCTGT CTCCGGGTAAA |
| 166 | Monomeric hu 4-1BBL (71-254)-CH1 | AGAGAGGGCCCTGAGCTGAGCCCCGATGATCCTGCTGG ACTGCTGGACCTGCGGCAGGGCATGTTTGCTCAGCTGG GGCCCAGAACGTGCTGCTGATCGATGGCCCCCTGTCCTG GTACAGCGATCCTGGACTGGCTGGCGTGTCACTGACAGG CGGCCTGAGCTACAAAGAGGACACCAAAGAACTGGTGG TGGCCAAGGCCGGCGTGTACTACGTGTTCTTTCAGCTGG AACTGCGGAGAGTGGTGGCCGGCGAAGGATCTGGCTCT GTGTCTCTGGCCCTGCATCTGCAGCCTCTGAGAAGCGCT GCTGGCGCTGCAGCTCTGGCTCTGACAGTGGATCTGCCT CCTGCCAGCTCCGAGGCCCGGAATAGCGCATTTGGGTTT CAAGGCCGGCTGCTGCACCTGTCTGCCGGCCAGAGACT GGGAGTGCATCTGCACACAGAGGCCAGAGCCAGGCACG CCTGGCAGCTGACACAGGGCGCTACAGTGCTGGGCCTG TTCAGAGTGACCCCCGAGATTCCTGCCGGCCTGCCTAGC CCTAGATCTGAAGGCGGCGGAGGTTCCGGAGGCGGAGG ATCTGCTAGCACCAAAGGCCCTTCCGTGTTCCTCTGGC TCCTAGCTCCAAGTCCACCTCTGGAGGCACCGCTGCTCT CGGATGCCTCGTGAAGGATTATTTTCCTGAGCCTGTGAC AGTGTCCTGGAATAGCGGAGCACTGACCTCTGGAGTGC ATACTTTCCCCGCTGTGCTGCAGTCCTCTGGACTGTACA GCCTGAGCAGCGTGGTGACAGTGCCCAGCAGCAGCCTG GGCACCCAGACCTACATCTGCAACGTGAACCACAAGCC CAGCAACACCAAGGTGGACAAGAAGGTGGAACCCAAGT CTTGT |
| 162 | anti-FAP (4B9) Fc hole chain | see Table 21 |
| 163 | anti-FAP (4B9) light chain | see Table 21 |
| 117 | Dimeric hu 4-1BBL (71-254)-CL Fc knob chain | REGPELSPDDPAGLLDLRQGMFAQLVAQNVLLIDGPLSWY SDPGLAGVSLTGGLSYKEDTKELVVAKAGVYYVFFQLELR RVVAGEGSGSVSLALHLQPLRSAAGAAALALTVDLPPASS EARNSAFGFQGRLLHLSAGQRLGVHLHTEARARHAWQLT QGATVLGLFRVTPEIPAGLPSPRSEGGGGSGGGGSREGPEL |

TABLE 22-continued

Sequences of monovalent FAP(4B9)-targeted human 4-1BB
ligand (71-254) containing Fc (kih) fusion molecule
Construct 2.2

| SEQ ID NO: | Description | Sequence |
|---|---|---|
| | | SPDDPAGLLDLRQGMFAQLVAQNVLLIDGPLSWYSDPGLA
GVSLTGGLSYKEDTKELVVAKAGVYYVFFQLELRRVVAG
EGSGSVSLALHLQPLRSAAGAAALALTVDLPPASSEARNS
AFGFQGRLLHLSAGQRLGVHLHTEARARHAWQLTQGATV
LGLFRVTPEIPAGLPSPRSEGGGGSGGGGSRTVAAPSVFIFP
PSDEQLKSGTASVVCLLNNFYPREAKVQWKVDNALQSGN
SQESVTEQDSKDSTYSLSSTLTLSKADYEKHKVYACEVTH
QGLSSPVTKSFNRGECDKTHTCPPCPAPEAAGGPSVFLFPP
KPKDTLMISRTPEVTCVVVDVSHEDPEVKFNWYVDGVEV
HNAKTKPREEQYNSTYRVVSVLTVLHQDWLNGKEYKCKV
SNKALGAPIEKTISKAKGQPREPQVYTLPPCRDELTKNQVS
LWCLVKGFYPSDIAVEWESNGQPENNYKTTPPVLDSDGSF
FLYSKLTVDKSRWQQGNVFSCSVMHEALHNHYTQKSLSL
SPGK |
| 118 | Monomeric hu 4-1BBL (71-254)-CH1 | REGPELSPDDPAGLLDLRQGMFAQLVAQNVLLIDGPLSWY
SDPGLAGVSLTGGLSYKEDTKELVVAKAGVYYVFFQLELR
RVVAGEGSGSVSLALHLQPLRSAAGAAALALTVDLPPASS
EARNSAFGFQGRLLHLSAGQRLGVHLHTEARARHAWQLT
QGATVLGLFRVTPEIPAGLPSPRSEGGGGSGGGGSASTKGP
SVFPLAPSSKSTSGGTAALGCLVKDYFPEPVTVSWNSGALT
SGVHTFPAVLQSSGLYSLSSVVTVPSSSLGTQTYICNVNHK
PSNTKVDKKVEPKSC |
| 164 | anti-FAP (4B9) Fc hole chain | see Table 21 |
| 125 | anti-FAP (4B9) light chain | see Table 21 |

2.1.3 Preparation of Bivalent FAP (4B9) Targeted 4-1BB Ligand (71-254) Trimer-Containing Fc (kih) Fusion Antigen Binding Molecule with the Dimeric and Monomeric 4-1BB Ligands Fused at the C-Terminus of Each Heavy Chain (Construct 2.3)

A polypeptide containing two ectodomains of 4-1BB ligand (71-254), separated by $(G_4S)_2$ (SEQ ID NO:13) linkers was fused to the C-terminus of human IgG1 Fc hole chain, as depicted in FIG. 1C: human IgG1 Fc hole, $(G_4S)_2$ (SEQ ID NO:13) connector, human 4-1BB ligand, $(G_4S)_2$ (SEQ ID NO:13) connector, human 4-1BB ligand. A polypeptide containing one ectodomain of 4-1BB ligand (71-254) and fused to the C-terminus of human IgG1 Fc knob chain as described in FIG. 1D: human IgG1 Fc knob, $(G_4S)_2$ (SEQ ID NO:13) connector, human 4-1BB ligand.

The polypeptide encoding the dimeric 4-1BB ligand was subcloned in frame at the C-terminus of human IgG1 heavy chain CH2 and CH3 domains on the hole (Merchant, Zhu et al. 1998) using a $(G_4S)_2$ (SEQ ID NO:13) connector. The polypeptide encoding the monomeric 4-1BB ligand was subcloned in frame at the C-terminus of human IgG1 heavy chain CH2 and CH3 domains on the knob (Merchant, Zhu et al. 1998) using a $(G_4S)_2$ (SEQ ID NO:13) connector.

The variable region of heavy and light chain DNA sequences encoding a binder specific for fibroblast activation protein (FAP), clone 4B9, were subcloned in frame with either the constant heavy chain of the hole, the knob or the constant light chain of human IgG1.

The Pro329Gly, Leu234Ala and Leu235Ala mutations have been introduced in the constant region of the knob and hole heavy chains to abrogate binding to Fc gamma receptors according to the method described in WO 2012/130831.

Combination of the anti-FAP huIgG1 hole dimeric ligand chain containing the Y349C/T366S/L368A/Y407V mutations, the anti-FAP huIgG1 knob monomeric ligand chain containing the S354C/T366W mutations and the anti-FAP light chain allows generation of a heterodimer, which includes an assembled trimeric 4-1BB ligand and two FAP binding Fabs (FIG. 4C, Construct 2.3)

Table 23 shows the cDNA and amino acid sequences of the bivalent FAP (4B9)-targeted 4-1BB ligand trimer-containing Fc (kih) fusion molecule Construct 2.3 (FAP split trimer with 2 anti-FAP Fabs, dimeric and monomeric 4-1BB ligand fused at the C-terminus of each heavy chain, respectively).

TABLE 23

Sequences of bivalent FAP(4B9)-targeted human 4-1BB ligand
(71-254) containing Fc (kih) fusion molecule Construct 2.3

| SEQ ID NO: | Description | Sequence |
|---|---|---|
| 167 | anti-FAP (4B9) Fc hole chain fused to dimeric hu 4-1BBL (71-254) | GAGGTGCAGCTGCTCGAAAGCGGCGGAGGACTGGTGCA
GCCTGGCGGCAGCCTGAGACTGTCTTGCGCCGCCAGCG
GCTTCACCTTCAGCAGCTACGCCATGAGCTGGGTCCGCC
AGGCCCCTGGCAAGGGACTGGAATGGGTGTCCGCCATC |

TABLE 23-continued

Sequences of bivalent FAP(4B9)-targeted human 4-1BB ligand
(71-254) containing Fc (kih) fusion molecule Construct 2.3

| SEQ ID NO: | Description | Sequence |
|---|---|---|
|  |  | ATCGGCTCTGGCGCCAGCACCTACTACGCCGACAGCGTG<br>AAGGGCCGGTTCACCATCAGCCGGGACAACAGCAAGAA<br>CACCCTGTACCTGCAGATGAACAGCCTGCGGGCCGAGG<br>ACACCGCCGTGTACTACTGCGCCAAGGGATGGTTCGGC<br>GGCTTCAACTACTGGGGACAGGGCACCCTGGTCACAGT<br>GTCCAGCGCTAGCACCAAGGGCCCCTCCGTGTTCCCCCT<br>GGCCCCCAGCAGCAAGAGCACCAGCGGCGGCACAGCCG<br>CTCTGGGCTGCCTGGTCAAGGACTACTTCCCCGAGCCCG<br>TGACCGTGTCCTGGAACAGCGGAGCCCTGACCTCCGGC<br>GTGCACACCTTCCCCGCCGTGCTGCAGAGTTCTGGCCTG<br>TATAGCCTGAGCAGCGTGGTCACCGTGCCTTCTAGCAGC<br>CTGGGCACCCAGACCTACATCTGCAACGTGAACCACAA<br>GCCCAGCAACACCAAGGTGGACAAGAAGGTGGAGCCCA<br>AGAGCTGCGACAAAACTCACACATGCCCACCGTGCCCA<br>GCACCTGAAGCTGCAGGGGGACCGTCAGTCTTCCTCTTC<br>CCCCCAAAACCCAAGGACACCCTCATGATCTCCCGGACC<br>CCTGAGGTCACATGCGTGGTGGTGGACGTGAGCCACGA<br>AGACCCTGAGGTCAAGTTCAACTGGTACGTGGACGGCG<br>TGGAGGTGCATAATGCCAAGACAAAGCCGCGGGAGGAG<br>CAGTACAACAGCACGTACCGTGTGGTCAGCGTCCTCACC<br>GTCCTGCACCAGGACTGGCTGAATGGCAAGGAGTACAA<br>GTGCAAGGTCTCCAACAAAGCCCTCGGCGCCCCCATCG<br>AGAAAACCATCTCCAAAGCCAAAGGGCAGCCCCGAGAA<br>CCACAGGTGTGCACCCTGCCCCCATCCCGGGATGAGCTG<br>ACCAAGAACCAGGTCAGCCTCTCGTGCGCAGTCAAAGG<br>CTTCTATCCCAGCGACATCGCCGTGGAGTGGGAGAGCA<br>ATGGGCAGCCGGAGAACAACTACAAGACCACGCCTCCC<br>GTGCTGGACTCCGACGGCTCCTTCTTCCTCGTGAGCAAG<br>CTCACCGTGGACAAGAGCAGGTGGCAGCAGGGGAACGT<br>CTTCTCATGCTCCGTGATGCATGAGGCTCTGCACAACCA<br>CTACACGCAGAAGAGCCTCTCCCTGTCTCCGGGTGGAGG<br>CGGCGGAAGCGGAGGAGGAGGATCCAGAGAGGGCCCT<br>GAGCTGAGCCCCGATGATCCTGCTGGACTGCTGGACCTG<br>CGGCAGGGCATGTTTGCTCAGCTGGTGGCCCAGAACGTG<br>CTGCTGATCGATGGCCCCCTGTCCTGGTACAGCGATCCT<br>GGACTGGCTGGCGTGTCACTGACAGGCGGCCTGAGCTA<br>CAAAGAGGACACCAAAGAACTGGTGGTGGCCAAGGCCG<br>GCGTGTACTACGTGTTCTTTCAGCTGGAACTGCGGAGAG<br>TGGTGGCCGGCGAAGGATCTGGCTCTGTGTCTCTGGCCC<br>TGCATCTGCAGCCTCTGAGAAGCGCTGCTGGCGCTGCAG<br>CTCTGGCACTGACAGTGGATCTGCCTCCTGCCAGCTCCG<br>AGGCCCGGAATAGCGCATTTGGGTTTCAAGGCAGGCTG<br>CTGCACCTGTCTGCCGGCCAGAGGCTGGGAGTGCATCTG<br>CACACAGAGGCCAGGGCTAGACACGCCTGGCAGCTGAC<br>ACAGGGCGCTACAGTGCTGGGCCTGTTCAGAGTGACCC<br>CCGAGATTCCAGCCGGCCTGCCTTCTCCAAGAAGCGAA<br>GGCGGAGGCGGATCTGGCGGCGGAGGATCTAGAGAGGG<br>ACCCGAACTGTCCCCTGACGATCCAGCCGGGCTGCTGGA<br>TCTGAGACAGGGAATGTTCGCCCAGCTGGTGGCTCAGA<br>ATGTGCTGCTGATTGACGGACCTCTGAGCTGGTACTCCG<br>ACCCAGGGCTGGCAGGGGTGTCCCTGACTGGGGGACTG<br>TCCTACAAAGAAGATACAAAAGAACTGGTGGTGGCTAA<br>AGCTGGGGTGTACTATGTGTTTTTTCAGCTGGAACTGAG<br>GCGGGTGGTGGCTGGGGAGGGCTCAGGATCTGTGTCCCT<br>GGCTCTGCATCTGCAGCCACTGCGCTCTGCTGCTGGCGC<br>AGCTGCACTGGCTCTGACTGTGGACCTGCCACCAGCCTC<br>TAGCGAGGCCAGAAACAGCGCCTTCGGGTTCCAAGGAC<br>GCCTGCTGCATCTGAGCGCCGACAGCGCCTGGGAGTG<br>CATCTGCATACTGAAGCCAGAGCCCGGCATGCTTGGCA<br>GCTGACTCAGGGGGCAACTGTGCTGGGACTGTTTCGCGT<br>GACACCTGAGATCCCTGCCGGACTGCCAAGCCCTAGATC<br>AGAA |
| 168 | anti-FAP (4B9) Fc knob chain fused to monomeric hu 4-1BBL (71-254) | GAGGTGCAGCTGCTCGAAAGCGGCGGAGGACTGGTGCA<br>GCCTGGCGGCAGCCTGAGACTGTCTTGCGCCGCCAGCG<br>GCTTCACCTTCAGCAGCTACGCCATGAGCTGGGTCCGCC<br>AGGCCCCTGGCAAGGGACTGGAATGGGTGTCCGCCATC<br>ATCGGCTCTGGCGCCAGCACCTACTACGCCGACAGCGTG<br>AAGGGCCGGTTCACCATCAGCCGGGACAACAGCAAGAA<br>CACCCTGTACCTGCAGATGAACAGCCTGCGGGCCGAGG<br>ACACCGCCGTGTACTACTGCGCCAAGGGATGGTTCGGC<br>GGCTTCAACTACTGGGGACAGGGCACCCTGGTCACAGT<br>GTCCAGCGCTAGCACCAAGGGCCCATCGGTCTTCCCCCT<br>GGCACCCTCCTCCAAGAGCACCTCTGGGGGCACAGCGG |

TABLE 23-continued

Sequences of bivalent FAP(4B9)-targeted human 4-1BB ligand
(71-254) containing Fc (kih) fusion molecule Construct 2.3

| SEQ ID NO: | Description | Sequence |
|---|---|---|
| | | CCCTGGGCTGCCTGGTCAAGGACTACTTCCCCGAACCGG<br>TGACGGTGTCGTGGAACTCAGGCGCCCTGACCAGCGGC<br>GTGCACACCTTCCCGGCTGTCCTACAGTCCTCAGGACTC<br>TACTCCCTCAGCAGCGTGGTGACCGTGCCCTCCAGCAGC<br>TTGGGCACCCAGACCTACATCTGCAACGTGAATCACAA<br>GCCCAGCAACACCAAGGTGGACAAGAAAGTTGAGCCCA<br>AATCTTGTGACAAAACTCACACATGCCCACCGTGCCCAG<br>CACCTGAAGCTGCAGGGGGACCGTCAGTCTTCCTCTTCC<br>CCCCAAAACCCAAGGACACCCTCATGATCTCCCGGACCC<br>CTGAGGTCACATGCGTGGTGGTGGACGTGAGCCACGAA<br>GACCCTGAGGTCAAGTTCAACTGGTACGTGGACGGCGT<br>GGAGGTGCATAATGCCAAGACAAAGCCGCGGGAGGAGC<br>AGTACAACAGCACGTACCGTGTGGTCAGCGTCCTCACCG<br>TCCTGCACCAGGACTGGCTGAATGGCAAGGAGTACAAG<br>TGCAAGGTCTCCAACAAAGCCCTCGGCGCCCCCATCGA<br>GAAAACCATCTCCAAAGCCAAAGGGCAGCCCCGAGAAC<br>CACAGGTGTACACCCTGCCCCCCTGCAGAGATGAGCTG<br>ACCAAGAACCAGGTGTCCCTGTGGTGTCTGGTCAAGGGC<br>TTCTACCCCAGCGATATCGCCGTGGAGTGGGAGAGCAA<br>CGGCCAGCCTGAGAACAACTACAAGACCACCCCCCCTG<br>TGCTGGACAGCGACGGCAGCTTCTTCCTGTACTCCAAAC<br>TGACCGTGGACAAGAGCCGGTGGCAGCAGGGCAACGTG<br>TTCAGCTGCAGCGTGATGCACGAGGCCCTGCACAACCA<br>CTACACCCAGAAGTCCCTGAGCCTGAGCCCCGGCGGAG<br>GCGGCGGAAGCGGAGGAGGAGGATCCAGAGAGGGCCC<br>TGAGCTGAGCCCCGATGATCCTGCTGGACTGCTGGACCT<br>GCGGCAGGGCATGTTTGCTCAGCTGGTGGCCCAGAACGT<br>GCTGCTGATCGATGGCCCCCTGTCCTGGTACAGCGATCC<br>TGGACTGGCTGGCGTGTCACTGACAGGCGGCCTGAGCTA<br>CAAAGAGGACACCAAAGAACTGGTGGTGGCCAAGGCCG<br>GCGTGTACTACGTGTTCTTTCAGCTGGAACTGCGGAGAG<br>TGGTGGCCGGCGAAGGATCTGGCTCTGTGTCTCTGGCCC<br>TGCATCTGCAGCCTCTGAGAAGCGCTGCTGGCGCTGCAG<br>CTCTGGCACTGACAGTGGATCTGCCTCCTGCCAGCTCCG<br>AGGCCCGGAATAGCGCATTTGGGTTTCAAGGCAGGCTG<br>CTGCACCTGTCTGCCGGCCAGAGGCTGGGAGTGCATCTG<br>CACACAGAGGCCAGGGCTAGACACGCCTGGCAGCTGAC<br>ACAGGGCGCTACAGTGCTGGGCCTGTTCAGAGTGACCC<br>CCGAGATTCCAGCCGGCCTGCCTTCTCCAAGAAGCGAA |
| 163 | anti-FAP (4B9) light chain | see Table 21 |
| 123 | anti-FAP (4B9) Fc hole chain fused to dimeric hu 4-1BBL (71-254) | EVQLLESGGGLVQPGGSLRLSCAASGFTFSSYAMSWVRQA<br>PGKGLEWVSAIIGSGASTYYADSVKGRFTISRDNSKNTLYL<br>QMNSLRAEDTAVYYCAKGWFGGFNYWGQGTLVTVSSAS<br>TKGPSVFPLAPSSKSTSGGTAALGCLVKDYFPEPVTVSWNS<br>GALTSGVHTFPAVLQSSGLYSLSSVVTVPSSSLGTQTYICN<br>VNHKPSNTKVDKKVEPKSCDKTHTCPPCPAPEAAGGPSVF<br>LFPPKPKDTLMISRTPEVTCVVVDVSHEDPEVKFNWYVDG<br>VEVHNAKTKPREEQYNSTYRVVSVLTVLHQDWLNGKEYK<br>CKVSNKALGAPIEKTISKAKGQPREPQVCTLPPSRDELTKN<br>QVSLSCAVKGFYPSDIAVEWESNGQPENNYKTTPPVLDSD<br>GSFFLVSKLTVDKSRWQQGNVFSCSVMHEALHNHYTQKS<br>LSLSPGGGGSGGGGSREGPELSPDDPAGLLDLRQGMFAQ<br>LVAQNVLLIDGPLSWYSDPGLAGVSLTGGLSYKEDTKELV<br>VAKAGVYYVFFQLELRRVVAGEGSGSVSLALHLQPLRSAA<br>GAAALALTVDLPPASSEARNSAFGFQGRLLHLSAGQRLGV<br>HLHTEARARHAWQLTQGATVLGLFRVTPEIPAGLPSPRSEG<br>GGGSGGGGSREGPELSPDDPAGLLDLRQGMFAQLVAQNV<br>LLIDGPLSWYSDPGLAGVSLTGGLSYKEDTKELVVAKAGV<br>YYVFFQLELRRVVAGEGSGSVSLALHLQPLRSAAGAAALA<br>LTVDLPPASSEARNSAFGFQGRLLHLSAGQRLGVHLHTEA<br>RARHAWQLTQGATVLGLFRVTPEIPAGLPSPRSE |
| 124 | anti-FAP (4B9) Fc knob chain fused to monomeric hu 4-1BBL (71-254) | EVQLLESGGGLVQPGGSLRLSCAASGFTFSSYAMSWVRQA<br>PGKGLEWVSAIIGSGASTYYADSVKGRFTISRDNSKNTLYL<br>QMNSLRAEDTAVYYCAKGWFGGFNYWGQGTLVTVSSAS<br>TKGPSVFPLAPSSKSTSGGTAALGCLVKDYFPEPVTVSWNS<br>GALTSGVHTFPAVLQSSGLYSLSSVVTVPSSSLGTQTYICN<br>VNHKPSNTKVDKKVEPKSCDKTHTCPPCPAPEAAGGPSVF<br>LFPPKPKDTLMISRTPEVTCVVVDVSHEDPEVKFNWYVDG<br>VEVHNAKTKPREEQYNSTYRVVSVLTVLHQDWLNGKEYK<br>CKVSNKALGAPIEKTISKAKGQPREPQVYTLPPCRDELTKN |

TABLE 23-continued

Sequences of bivalent FAP(4B9)-targeted human 4-1BB ligand (71-254) containing Fc (kih) fusion molecule Construct 2.3

| SEQ ID NO: | Description | Sequence |
|---|---|---|
| | | QVSLWCLVKGFYPSDIAVEWESNGQPENNYKTTPPVLDSD<br>GSFFLYSKLTVDKSRWQQGNVFSCSVMHEALHNHYTQKS<br>LSLSPGGGGSGGGGSREGPELSPDDPAGLLDLRQGMFAQ<br>LVAQNVLLIDGPLSWYSDPGLAGVSLTGGLSYKEDTKELV<br>VAKAGVYYVFFQLELRRVVAGEGSGSVSLALHLQPLRSAA<br>GAAALALTVDLPPASSEARNSAFGFQGRLLHLSAGQRLGV<br>HLHTEARARHAWQLTQGATVLGLFRVTPEIPAGLPSPRSE |
| 125 | anti-FAP (4B9) light chain | see Table 21 |

2.1.4 Preparation of Monovalent FAP (4B9) Targeted 4-1BB Ligand (71-248) Trimer-Containing Fc (kih) Fusion Antigen Binding Molecule with Crossed CH1-CL Domains with Charged Residues (Construct 2.4)

A polypeptide containing two ectodomains of 4-1BB ligand (71-248), separated by $(G_4S)_2$ (SEQ ID NO:13) linkers, and fused to the human IgG1-CL domain, was cloned as depicted in FIG. 1A: human 4-1BB ligand, $(G_4S)_2$ (SEQ ID NO:13) connector, human 4-1BB ligand, $(G_4S)_2$ (SEQ ID NO:13) connector, human CL. A polypeptide containing one ectodomain of 4-1BB ligand (71-248) and fused to the human IgG1-CH domain, was cloned as described in FIG. 1B: human 4-1BB ligand, $(G_4S)_2$ (SEQ ID NO:13) connector, human CH.

The polypeptide encoding the dimeric 4-1BB ligand fused to human CL domain was subcloned in frame with the human IgG1 heavy chain CH2 and CH3 domains on the knob (Merchant, Zhu et al. 1998) using a linker $(G_4S)_2$ (SEQ ID NO:13) or, alternatively, GSPGSSSSGS (SEQ ID NO:57). To improve correct pairing the following mutations have been introduced in the crossed CH-CL. In the dimeric 4-1BB ligand fused to human CL, E123R and Q124K. In the monomeric 4-1BB ligand fused to human CH1, K147E and K213E.

The variable region of heavy and light chain DNA sequences encoding a binder specific for fibroblast activation protein (FAP), clone 4B9, were subcloned in frame with either the constant heavy chain of the hole or the constant light chain of human IgG1.

The Pro329Gly, Leu234Ala and Leu235Ala mutations have been introduced in the constant region of the knob and hole heavy chains to abrogate binding to Fc gamma receptors according to the method described in WO 2012/130831.

Combination of the dimeric ligand-Fc knob chain containing the S354C/T366W mutations, the monomeric CH1 fusion, the targeted anti-FAP-Fc hole chain containing the Y349C/T366S/L368A/Y407V mutations and the anti-FAP light chain allows generation of a heterodimer, which includes an assembled trimeric 4-1BB ligand and a FAP binding Fab (FIG. 4D, Construct 2.4).

Table 24 shows the cDNA and amino acid sequences of the monovalent FAP (4B9)-human 4-1BB ligand (71-248) Fc (kih) fusion antigen binding molecule containing CH1-CL crossover with charged residues (Construct 2.4).

TABLE 24

Sequences of monovalent FAP(4B9)-targeted human 4-1BB ligand (71-248) containing Fc (kih) fusion molecule Construct 2.4

| SEQ ID NO: | Description | Sequence |
|---|---|---|
| 169 | Dimeric hu 4-1BBL (71-248)-CL* Fc knob chain | AGAGAGGGCCCTGAGCTGAGCCCCGATGATCCTGCTGG<br>ACTGCTGGACCTGCGGCAGGGCATGTTTGCTCAGCTGGT<br>GGCCCAGAACGTGCTGCTGATCGATGGCCCCCTGTCCTG<br>GTACAGCGATCCTGGACTGGCTGGCGTGTCACTGACAGG<br>CGGCCTGAGCTACAAAGAGGACACCAAAGAACTGGTGG<br>TGGCCAAGGCCGGCGTGTACTACGTGTTCTTTCAGCTGG<br>AACTGCGGAGAGTGGTGGCCGGCGAAGGATCTGGCTCT<br>GTGTCTCTGGCCCTGCATCTGCAGCCTCTGAGATCTGCT<br>GCTGGCGCCGCTGCTCTGGCACTGACAGTGGATCTGCCT<br>CCTGCCAGCAGCGAGGCCCGGAATAGCGCATTTGGGTTT<br>CAAGGCAGGCTGCTGCACCTGTCTGCCGGCCAGAGGCT<br>GGGAGTGCATCTGCACACAGAGGCCAGGGCTAGACACG<br>CCTGGCAGCTGACACAGGGCGCTACAGTGCTGGGCCTG<br>TTCAGAGTGACCCCCGAGATTCCAGCCGGACTGGGAGG<br>CGGCGGATCTGGCGGCGGAGGATCTAGAGAAGGACCCG<br>AGCTGTCCCCTGACGATCCAGCCGGGCTGCTGGATCTGA<br>GACAGGGAATGTTCGCCCAGCTGGTGGCTCAGAATGTG<br>CTGCTGATTGACGGACCTCTGAGCTGGTACTCCGACCCA<br>GGGCTGGCAGGGGTGTCCCTGACTGGGGGACTGTCCTAC<br>AAAGAAGATACAAAAGAACTGGTGGTGGCTAAAGCTGG<br>GGTGTACTATGTGTTTTTTCAGCTGGAACTGAGGCGGGT<br>GGTGGCTGGGGAGGGCTCAGGATCTGTGTCCCTGGCTCT<br>GCATCTGCAGCCACTGCGCTCTGCAGCAGGGGCTGCAG |

TABLE 24-continued

Sequences of monovalent FAP(4B9)-targeted human 4-1BB
ligand (71-248) containing Fc (kih) fusion molecule
Construct 2.4

| SEQ ID NO: | Description | Sequence |
|---|---|---|
| | | CACTGGCCCTGACTGTGGACCTGCCCCCAGCTTCTTCCG<br>AGGCCAGAAACAGCGCCTTCGGGTTCCAAGGACGCCTG<br>CTGCATCTGAGCGCCGGACAGCGCCTGGGAGTGCATCT<br>GCATACTGAAGCCAGAGCCCGGCATGCTTGGCAGCTGA<br>CTCAGGGGGCAACTGTGCTGGGACTGTTTCGCGTGACAC<br>CTGAGATCCCCGCTGGACTGGGCGGAGGCGGTTCCGGA<br>GGGGGAGGATCTCGTACGGTGGCTGCACCATCTGTCTTT<br>ATCTTCCCACCCAGCGACCGGAAGCTGAAGTCTGGCAC<br>AGCCAGCGTCGTGTGCCTGCTGAATAACTTCTACCCCCG<br>CGAGGCCAAGGTGCAGTGGAAGGTGGACAATGCCCTGC<br>AGAGCGGCAACAGCCAGGAAAGCGTGACCGAGCAGGA<br>CAGCAAGGACTCCACCTACAGCCTGAGCAGCACCCTGA<br>CCCTGAGCAAGGCCGACTACGAGAAGCACAAGGTGTAC<br>GCCTGCGAAGTGACCCACCAGGGCCTGTCTAGCCCCGTG<br>ACCAAGAGCTTCAACCGGGGCGAGTGCGACAAGACCCA<br>CACCTGTCCTCCATGCCCTGCCCCTGAAGCTGCTGGCGG<br>CCCTAGCGTGTTCCTGTTCCCCCCAAAGCCCAAGGACAC<br>CCTGATGATCAGCCGGACCCCTGAAGTGACCTGCGTGGT<br>GGTGGATGTGTCCCACGAGGACCCTGAAGTGAAGTTCA<br>ATTGGTACGTGGACGGCGTGGAAGTGCACAATGCCAAG<br>ACCAAGCCGCGGGAGGAGCAGTACAACAGCACGTACCG<br>TGTGGTCAGCGTCCTCACCGTCCTGCACCAGGACTGGCT<br>GAATGGCAAGGAGTACAAGTGCAAGGTCTCCAACAAAG<br>CCCTCGGCGCCCCCATCGAGAAAACCATCTCCAAAGCC<br>AAAGGGCAGCCCCGAGAACCACAGGTGTACACCCTGCC<br>CCCATGCCGGGATGAGCTGACCAAGAACCAGGTCAGCC<br>TGTGGTGCCTGGTCAAAGGCTTCTATCCCAGCGACATCG<br>CCGTGGAGTGGGAGAGCAATGGGCAGCCGGAGAACAAC<br>TACAAGACCACGCCTCCCGTGCTGGACTCCGACGGCTCC<br>TTCTTCCTCTACAGCAAGCTCACCGTGGACAAGAGCAGG<br>TGGCAGCAGGGGAACGTCTTCTCATGCTCCGTGATGCAT<br>GAGGCTCTGCACAACCACTACACGCAGAAGAGCCTCTC<br>CCTGTCTCCGGGTAAA |
| 170 | Monomeric hu 4-<br>1BBL (71-248)-<br>CH1* | AGAGAGGGCCCTGAGCTGAGCCCCGATGATCCTGCTGG<br>ACTGCTGGACCTGCGGCAGGGCATGTTTGCTCAGCTGGT<br>GGCCCAGAACGTGCTGCTGATCGATGGCCCCCTGTCCTG<br>GTACAGCGATCCTGGACTGGCTGGCGTGTCACTGACAGG<br>CGGCCTGAGCTACAAAGAGGACACCAAAGAACTGGTGG<br>TGGCCAAGGCCGGCGTGTACTACGTGTTCTTTCAGCTGG<br>AACTGCGGAGAGTGGTGGCCGGCGAAGGATCTGGCTCT<br>GTGTCTCTGGCCCTGCATCTGCAGCCTCTGAGATCTGCT<br>GCTGGCGCCGCTGCTCTGGCACTGACAGTGGATCTGCCT<br>CCTGCCAGCAGCGAGGCCCGGAATAGCGCATTTGGGTTT<br>CAAGGCAGGCTGCTGCACCTGTCTGCCGGCCAGAGGCT<br>GGGAGTGCATCTGCACACAGAGGCCAGGGCTAGACACG<br>CCTGGCAGCTGACACAGGGCGCTACAGTGCTGGGCCTG<br>TTCAGAGTGACCCCCGAGATTCCAGCCGGACTGGGAGG<br>CGGAGGTTCCGGAGGCGGAGGATCTGCTAGCACAAAGG<br>GCCCCAGCGTGTTCCCTCTGGCCCCTAGCAGCAAGAGCA<br>CATCTGGCGGAACAGCCGCCCTGGGCTGCCTGGTGGAA<br>GATTACTTCCCCGAGCCCGTGACCGTGTCCTGGAATTCT<br>GGCGCCCTGACAAGCGGCGTGCACACCTTTCCAGCCGTG<br>CTGCAGAGCAGCGGCCTGTACTCTCTGAGCAGCGTCGTG<br>ACAGTGCCCAGCAGCTCTCTGGGCACCCAGACCTACATC<br>TGCAACGTGAACCACAAGCCCAGCAACACCAAGGTGGA<br>CGAGAAGGTGGAACCCAAGTCCTGC |
| 162 | anti-FAP (4B9)<br>Fc hole chain | see Table 21 |
| 163 | anti-FAP (4B9)<br>light chain | see Table 21 |
| 119 | Dimeric hu 4-<br>1BBL (71-248)-<br>CL* Fc knob<br>chain | REGPELSPDDPAGLLDLRQGMFAQLVAQNVLLIDGPLSWY<br>SDPGLAGVSLTGGLSYKEDTKELVVAKAGVYYVFFQLELR<br>RVVAGEGSGSVSLALHLQPLRSAAGAAALALTVDLPPASS<br>EARNSAFGFQGRLLHLSAGQRLGVHLHTEARARHAWQLT<br>QGATVLGLFRVTPEIPAGLGGGSGGGGSREGPELSPDDPA<br>GLLDLRQGMFAQLVAQNVLLIDGPLSWYSDPGLAGVSLTG<br>GLSYKEDTKELVVAKAGVYYVFFQLELRRVVAGEGSGSV<br>SLALHLQPLRSAAGAAALALTVDLPPASSEARNSAFGFQG<br>RLLHLSAGQRLGVHLHTEARARHAWQLTQGATVLGLFRV |

TABLE 24-continued

Sequences of monovalent FAP(4B9)-targeted human 4-1BB ligand (71-248) containing Fc (kih) fusion molecule Construct 2.4

| SEQ ID NO: | Description | Sequence |
|---|---|---|
| | | TPEIPAGLGGGGSGGGGSRTVAAPSVFIFPPSDRKLKSGTAS VVCLLNNFYPREAKVQWKVDNALQSGNSQESVTEQDSKD STYSLSSTLTLSKADYEKHKVYACEVTHQGLSSPVTKSFNR GECDKTHTCPPCPAPEAAGGPSVFLFPPKPKDTLMISRTPE VTCVVVDVSHEDPEVKFNWYVDGVEVHNAKTKPREEQY NSTYRVVSVLTVLHQDWLNGKEYKCKVSNKALGAPIEKTI SKAKGQPREPQVYTLPPCRDELTKNQVSLWCLVKGFYPSD IAVEWESNGQPENNYKTTPPVLDSDGSFFLYSKLTVDKSR WQQGNVFSCSVMHEALHNHYTQKSLSLSPGK |
| 120 | Monomeric hu 4-1BBL (71-248)-CH1* | REGPELSPDDPAGLLDLRQGMFAQLVAQNVLLIDGPLSWY SDPGLAGVSLTGGLSYKEDTKELVVAKAGVYYVFFQLELR RVVAGEGSGSVSLALHLQPLRSAAGAAALALTVDLPPASS EARNSAFGFQGRLLHLSAGQRLGVHLHTEARARHAWQLT QGATVLGLFRVTPEIPAGLGGGGSGGGGSASTKGPSVFPLA PSSKSTSGGTAALGCLVEDYFPEPVTVSWNSGALTSGVHTF PAVLQSSGLYSLSSVVTVPSSSLGTQTYICNVNHKPSNTKV DEKVEPKSC |
| 164 | anti-FAP (4B9) Fc hole chain | see Table 21 |
| 125 | anti-FAP (4B9) light chain | see Table 21 |

2.1.5 Preparation of Monovalent FAP (4B9) Targeted 4-1BB Ligand (71-248) Trimer-Containing Fc (kih) Fusion Antigen Binding Molecule with Crossed CH1-CL Domains without Charged Residues (Construct 2.5)

A polypeptide containing two ectodomains of 4-1BB ligand (71-248), separated by $(G_4S)_2$ (SEQ ID NO:13) linkers, and fused to the human IgG1-CL domain, was cloned as depicted in FIG. 1A: human 4-1BB ligand, $(G_4S)_2$ (SEQ ID NO:13) connector, human 4-1BB ligand, $(G_4S)_2$ (SEQ ID NO:13) connector, human CL. A polypeptide containing one ectodomain of 4-1BB ligand (71-248) and fused to the human IgG1-CH domain, was cloned as described in FIG. 1B: human 4-1BB ligand, $(G_4S)_2$ (SEQ ID NO:13) connector, human CH.

The polypeptide encoding the dimeric 4-1BB ligand fused to human CL domain was subcloned in frame with the human IgG1 heavy chain CH2 and CH3 domains on the knob (Merchant, Zhu et al. 1998) using a linker $(G_4S)_2$ (SEQ ID NO:13) or, alternatively, GSPGSSSSGS (SEQ ID NO:57).

The variable region of heavy and light chain DNA sequences encoding a binder specific for fibroblast activation protein (FAP), clone 4B9, were subcloned in frame with either the constant heavy chain of the hole or the constant light chain of human IgG1.

The Pro329Gly, Leu234Ala and Leu235Ala mutations have been introduced in the constant region of the knob and hole heavy chains to abrogate binding to Fc gamma receptors according to the method described in WO 2012/130831.

Combination of the dimeric ligand-Fc knob chain containing the S354C/T366W mutations, the monomeric CH1 fusion, the targeted anti-FAP-Fc hole chain containing the Y349C/T366S/L368A/Y407V mutations and the anti-FAP light chain allows generation of a heterodimer, which includes an assembled trimeric 4-1BB ligand and a FAP binding Fab (FIG. 4E, Construct 2.5)

Table 25 shows the cDNA and amino acid sequences of the monovalent FAP (4B9)-human 4-1BB ligand (71-248) Fc (kih) fusion antigen binding molecule containing CH1-CL crossover without charged residues (Construct 2.5).

TABLE 25

Sequences of monovalent FAP(4B9)-targeted human 4-1BB ligand (71-248) containing Fc (kih) fusion molecule Construct 2.5

| SEQ ID NO: | Description | Sequence |
|---|---|---|
| 171 | nucleotide sequence dimeric hu 4-1BBL (71-248)-CL Fc knob chain | AGAGAGGGCCCTGAGCTGAGCCCCGATGATCCTGCTGG ACTGCTGGACCTGCGGCAGGGCATGTTTGCTCAGCTGGT GGCCCAGAACGTGCTGCTGATCGATGGCCCCCTGTCCTG GTACAGCGATCCTGGACTGGCTGGCGTGTCACTGACAGG CGGCCTGAGCTACAAAGAGGACACCAAAGAACTGGTGG TGGCCAAGGCCGGCGTGTACTACGTGTTCTTTCAGCTGG AACTGCGGAGAGTGGTGGCCGGCGAAGGATCTGGCTCT GTGTCTCTGGCCCTGCATCTGCAGCCTCTGAGATCTGCT GCTGGCGCCGCTGCTCTGGCACTGACAGTGGATCTGCCT CCTGCCAGCAGCGAGGCCCGGAATAGCGCATTTGGGTTT CAAGGCAGGCTGCTGCACCTGTCTGCCGGCCAGAGGCT |

TABLE 25-continued

Sequences of monovalent FAP(4B9)-targeted human 4-1BB ligand (71-248) containing Fc (kih) fusion molecule Construct 2.5

| SEQ ID NO: | Description | Sequence |
|---|---|---|
| | | GGGAGTGCATCTGCACACAGAGGCCAGGGCTAGACACG CCTGGCAGCTGACACAGGGCGCTACAGTGCTGGGCCTG TTCAGAGTGACCCCCGAGATTCCAGCCGGACTGGGAGG CGGCGGATCTGGCGGCGGAGGATCTAGAGAAGGACCCG AGCTGTCCCCTGACGATCCAGCCGGGCTGCTGGATCTGA GACAGGGAATGTTCGCCCAGCTGGTGGCTCAGAATGTG CTGCTGATTGACGGACCTCTGAGCTGGTACTCCGACCCA GGGCTGGCAGGGGTGTCCCTGACTGGGGGACTGTCCTAC AAAGAAGATACAAAAGAACTGGTGGTGGCTAAAGCTGG GGTGTACTATGTGTTTTTTCAGCTGGAACTGAGGCGGGT GGTGGCTGGGGAGGGCTCAGGATCTGTGTCCCTGGCTCT GCATCTGCAGCCACTGCGCTCTGCAGCAGGGGCTGCAG CACTGGCCCTGACTGTGGACCTGCCCCCAGCTTCTTCCG AGGCCAGAAACAGCGCCTTCGGGTTCCAAGGACGCCTG CTGCATCTGAGCGCCGGACAGCGCCTGGGAGTGCATCT GCATACTGAAGCCAGAGCCCGGCATGCTTGGCAGCTGA CTCAGGGGGCAACTGTGCTGGGACTGTTTCGCGTGACAC CTGAGATCCCCGCTGGACTGGGCGGAGGCGGTTCCGGA GGGGGAGGATCTCGTACGGTGGCCGCTCCCTCCGTGTTT ATCTTTCCCCCATCCGATGAACAGCTGAAAAGCGGCACC GCCTCCGTCGTGTGTCTGCTGAACAATTTTTACCCTAGG GAAGCTAAAGTGCAGTGGAAAGTGGATAACGCACTGCA GTCCGGCAACTCCCAGGAATCTGTGACAGAACAGGACT CCAAGGACAGCACCTACTCCCTGTCCTCCACCCTGACAC TGTCTAAGGCTGATTATGAGAAACACAAAGTCTACGCCT GCGAAGTCACCCATCAGGGCCTGAGCTCGCCCGTCACA AAGAGCTTCAACAGGGGAGAGTGTGACAAGACCCACAC CTGTCCCCCTTGTCCTGCCCCTGAAGCTGCTGGCGGCCC TTCTGTGTTCCTGTTCCCCCCAAAGCCCAAGGACACCCT GATGATCAGCCGGACCCCCGAAGTGACCTGCGTGGTGG TGGATGTGTCCCACGAGGACCCTGAAGTGAAGTTCAATT GGTACGTGGACGGCGTGGAAGTGCACAATGCCAAGACC AAGCCGCGGGAGGAGCAGTACAACAGCACGTACCGTGT GGTCAGCGTCCTCACCGTCCTGCACCAGGACTGGCTGAA TGGCAAGGAGTACAAGTGCAAGGTCTCCAACAAAGCCC TCGGCGCCCCCATCGAGAAAACCATCTCCAAAGCCAAA GGGCAGCCCCGAGAACCACAGGTGTACACCCTGCCCCC ATGCCGGGATGAGCTGACCAAGAACCAGGTCAGCCTGT GGTGCCTGGTCAAAGGCTTCTATCCCAGCGACATCGCCG TGGAGTGGGAGAGCAATGGGCAGCCGGAGAACAACTAC AAGACCACGCCTCCCGTGCTGGACTCCGACGGCTCCTTC TTCCTCTACAGCAAGCTCACCGTGGACAAGAGCAGGTG GCAGCAGGGGAACGTCTTCTCATGCTCCGTGATGCATGA GGCTCTGCACAACCACTACACGCAGAAGAGCCTCTCCCT GTCTCCGGGTAAA |
| 172 | Monomeric hu 4-1BBL (71-248)-CH1 | AGAGAGGGCCCTGAGCTGAGCCCCGATGATCCTGCTGG ACTGCTGGACCTGCGGCAGGGCATGTTTGCTCAGCTGGT GGGCCAGAACGTGCTGCTGATCGATGGCCCCCTGTCCTG GTACAGCGATCCTGGACTGGCTGGCGTGCACTGACAGG CGGCCTGAGCTACAAAGAGGACACCAAAGAACTGGTGG TGGCCAAGGCCGGCGTGTACTACGTGTTCTTTCAGCTGG AACTGCGGAGAGTGGTGGCCGGCGAAGGATCTGGCTCT GTGTCTCTGGCCCTGCATCTGCAGCCTCTGAGATCTGCT GCTGGCGCCGCTGCTCTGGCACTGACAGTGGATCTGCCT CCTGCCAGCAGCGAGGCCCGGAATAGCGCATTTGGGTTT CAAGGCAGGCTGCTGCACCTGTCTGCCGGCCAGAGGCT GGGAGTGCATCTGCACACAGAGGCCAGGGCTAGACACG CCTGGCAGCTGACACAGGGCGCTACAGTGCTGGGCCTG TTCAGAGTGACCCCCGAGATTCCAGCCGGACTGGGAGG CGGAGGTTCCGGAGGCGGAGGATCTGCTAGCACCAAAG GCCCTTCCGTGTTTCCTCTGGCTCCTAGCTCCAAGTCCAC CTCTGGAGGCACCGCTGCTCTCGGATGCCTCGTGAAGGA TTATTTTCCTGAGCCTGTGACAGTGTCCTGGAATAGCGG AGCACTGACCTCTGGAGTGCATACTTTCCCCGCTGTGCT GCAGTCCTCTGGACTGTACAGCCTGAGCAGCGTGGTGAC AGTGCCCAGCAGCAGCCTGGGCACCCAGACCTACATCT GCAACGTGAACCACAAGCCCAGCAACACCAAGGTGGAC AAGAAGGTGGAACCCAAGTCTTGT |

TABLE 25-continued

Sequences of monovalent FAP(4B9)-targeted human 4-1BB
ligand (71-248) containing Fc (kih) fusion molecule
Construct 2.5

| SEQ ID NO: | Description | Sequence |
|---|---|---|
| 162 | anti-FAP (4B9) Fc hole chain | see Table 21 |
| 163 | anti-FAP (4B9) light chain | see Table 21 |
| 173 | Dimeric hu 4-1BBL (71-248)-CL Fc knob chain | REGPELSPDDPAGLLDLRQGMFAQLVAQNVLLIDGPLSWY SDPGLAGVSLTGGLSYKEDTKELVVAKAGVYYVFFQLELR RVVAGEGSGSVSLALHLQPLRSAAGAAALALTVDLPPASS EARNSAFGFQGRLLHLSAGQRLGVHLHTEARARHAWQLT QGATVLGLFRVTPEIPAGLGGGGSGGGGSREGPELSPDDPA GLLDLRQGMFAQLVAQNVLLIDGPLSWYSDPGLAGVSLTG GLSYKEDTKELVVAKAGVYYVFFQLELRRVVAGEGSGSV SLALHLQPLRSAAGAAALALTVDLPPASSEARNSAFGFQG RLLHLSAGQRLGVHLHTEARARHAWQLTQGATVLGLFRV TPEIPAGLGGGGSGGGGSRTVAAPSVFIFPPSDEQLKSGTAS VVCLLNNFYPREAKVQWKVDNALQSGNSQESVTEQDSKD STYSLSSTLTLSKADYEKHKVYACEVTHQGLSSPVTKSFNR GECDKTHTCPPCPAPEAAGGPSVFLFPPKPKDTLMISRTPE VTCVVVDVSHEDPEVKFNWYVDGVEVHNAKTKPREEQY NSTYRVVSVLTVLHQDWLNGKEYKCKVSNKALGAPIEKTI SKAKGQPREPQVYTLPPCRDELTKNQVSLWCLVKGFYPSD IAVEWESNGQPENNYKTTPPVLDSDGSFFLYSKLTVDKSR WQQGNVFSCSVMHEALHNHYTQKSLSLSPGK |
| 174 | Monomeric hu 4-1BBL (71-248)-CH1 | REGPELSPDDPAGLLDLRQGMFAQLVAQNVLLIDGPLSWY SDPGLAGVSLTGGLSYKEDTKELVVAKAGVYYVFFQLELR RVVAGEGSGSVSLALHLQPLRSAAGAAALALTVDLPPASS EARNSAFGFQGRLLHLSAGQRLGVHLHTEARARHAWQLT QGATVLGLFRVTPEIPAGLGGGGSGGGGSASTKGPSVFPLA PSSKSTSGGTAALGCLVKDYFPEPVTVSWNSGALTSGVHT FPAVLQSSGLYSLSSVVTVPSSSLGTQTYICNVNHKPSNTK VDKKVEPKSC |
| 164 | anti-FAP (4B9) Fc hole chain | see Table 21 |
| 125 | anti-FAP (4B9) light chain | see Table 21 |

2.1.6 Preparation of bivalent FAP (4B9) targeted 4-1BB ligand (71-248) trimer-containing Fc (kih) fusion antigen binding molecule with the dimeric and monomeric 4-1BB ligands fused at the C-terminus of each heavy chain (Construct 2.6)

A polypeptide containing two ectodomains of 4-1BB ligand (71-248), separated by $(G_4S)_2$ (SEQ ID NO:13) linkers was fused to the C-terminus of human IgG1 Fc hole chain, as depicted in FIG. 1C: human IgG1 Fc hole, $(G_4S)_2$ (SEQ ID NO:13) connector, human 4-1BB ligand, $(G_4S)_2$ (SEQ ID NO:13) connector, human 4-1BB ligand. A polypeptide containing one ectodomain of 4-1BB ligand (71-248) and fused to the C-terminus of human IgG1 Fc knob chain as described in FIG. 1D: human IgG1 Fc knob, $(G_4S)_2$ (SEQ ID NO:13) connector, human 4-1BB ligand.

The polypeptide encoding the dimeric 4-1BB ligand was subcloned in frame at the C-terminus of human IgG1 heavy chain CH2 and CH3 domains on the hole (Merchant, Zhu et al. 1998) using a $(G_4S)_2$ (SEQ ID NO:13) connector. The polypeptide encoding the monomeric 4-1BB ligand was subcloned in frame at the C-terminus of human IgG1 heavy chain CH2 and CH3 domains on the knob (Merchant, Zhu et al. 1998) using a $(G_4S)_2$ (SEQ ID NO:13) connector.

The variable region of heavy and light chain DNA sequences encoding a binder specific for fibroblast activation protein (FAP), clone 4B9, were subcloned in frame with either the constant heavy chain of the hole, the knob or the constant light chain of human IgG1.

The Pro329Gly, Leu234Ala and Leu235Ala mutations have been introduced in the constant region of the knob and hole heavy chains to abrogate binding to Fc gamma receptors according to the method described in WO 2012/130831.

Combination of the anti-FAP huIgG1 hole dimeric ligand chain containing the Y349C/T366S/L368A/Y407V mutations, the anti-FAP huIgG1 knob monomeric ligand chain containing the S354C/T366W mutations and the anti-FAP light chain allows generation of a heterodimer, which includes an assembled trimeric 4-1BB ligand and two FAP binding Fabs (FIG. 4F, Construct 2.6).

Table 26 shows the cDNA and amino acid sequences of the bivalent FAP (4B9)-targeted 4-1BB ligand trimer-containing Fc (kih) fusion molecule Construct 2.6 (FAP split trimer with 2 anti-FAP Fabs, dimeric and monomeric 4-1BB ligand fused at the C-terminus of each heavy chain, respectively).

TABLE 26

Sequences of bivalent FAP(4B9)-targeted human 4-1BB ligand
(71-248) containing Fc (kih) fusion molecule Construct 2.6

| SEQ ID NO: | Description | Sequence |
|---|---|---|
| 175 | nucleotide sequence of anti-FAP (4B9) Fc hole chain fused to dimeric hu 4-1BBL (71-248) | GAGGTGCAGCTGCTCGAAAGCGGCGGAGGACTGGTGCA GCCTGGCGGCAGCCTGAGACTGTCTTGCGCCGCCAGCG GCTTCACCTTCAGCAGCTACGCCATGAGCTGGGTCCGCC AGGCCCCTGGCAAGGGACTGGAATGGGTGTCCGCCATC ATCGGCTCTGGCGCCAGCACCTACTACGCCGACAGCGTG AAGGGCCGGTTCACCATCAGCCGGGACAACAGCAAGAA CACCCTGTACCTGCAGATGAACAGCCTGCGGGCCGAGG ACACCGCCGTGTACTACTGCGCCAAGGGATGGTTCGGC GGCTTCAACTACTGGGGACAGGGCACCCTGGTCACAGT GTCCAGCGCTAGCACCAAGGGCCCCTCCGTGTTCCCCCT GGCCCCCAGCAGCAAGAGCACCAGCGGCGGCACAGCCG CTCTGGGCTGCCTGGTCAAGGACTACTTCCCCGAGCCCG TGACCGTGTCCTGGAACAGCGGAGCCCTGACCTCCGGC GTGCACACCTTCCCCGCCGTGCTGCAGAGTTCTGGCCTG TATAGCCTGAGCAGCGTGGTCACCGTGCCTTCTAGCAGC CTGGGCACCCAGACCTACATCTGCAACGTGAACCACAA GCCCAGCAACACCAAGGTGGACAAGAAGGTGGAGCCCA AGAGCTGCGACAAAACTCACACATGCCCACCGTGCCCA GCACCTGAAGCTGCAGGGGGACCGTCAGTCTTCCTCTTC CCCCCAAAACCCAAGGACACCCTCATGATCTCCCGGACC CCTGAGGTCACATGCGTGGTGGTGGACGTGAGCCACGA AGACCCTGAGGTCAAGTTCAACTGGTACGTGGACGGCG TGGAGGTGCATAATGCCAAGACAAAGCCGCGGGAGGAG CAGTACAACAGCACGTACCGTGTGGTCAGCGTCCTCACC GTCCTGCACCAGGACTGGCTGAATGGCAAGGAGTACAA GTGCAAGGTCTCCAACAAAGCCCTCGGCGCCCCCATCG AGAAAACCATCTCCAAAGCCAAAGGGCAGCCCCGAGAA CCACAGGTGTGCACCCTGCCCCCATCCCGGGATGAGCTG ACCAAGAACCAGGTCAGCCTCTCGTGCGCAGTCAAAGG CTTCTATCCCAGCGACATCGCCGTGGAGTGGGAGAGCA ATGGGCAGCCGGAGAACAACTACAAGACCACGCCTCCC GTGCTGGACTCCGACGGCTCCTTCTTCCTCGTGAGCAAG CTCACCGTGGACAAGAGCAGGTGGCAGCAGGGGAACGT CTTCTCATGCTCCGTGATGCATGAGGCTCTGCACAACCA CTACACGCAGAAGAGCCTCTCCCTGTCTCCGGGTGGAGG CGGCGGAAGCGGAGGAGGAGGATCCAGAGAGGGCCCT GAGCTGAGCCCCGATGATCCTGCTGGACTGCTGGACCTG CGGCAGGGCATGTTTGCTCAGCTGGTGGCCCAGAACGTG CTGCTGATCGATGGCCCCCTGTCCTGGTACAGCGATCCT GGACTGGCTGGCGTGTCACTGACAGGCGGCCTGAGCTA CAAAGAGGACACCAAAGAACTGGTGGTGGCCAAGGCCG GCGTGTACTACGTGTTCTTTCAGCTGGAACTGCGGAGAG TGGTGGCCGGCGAAGGATCTGGCTCTGTGTCTCTGGCCC TGCATCTGCAGCCTCTGAGAAGCGCTGCTGGCGCTGCAG CTCTGGCACTGACAGTGGATCTGCCTCCTGCCAGCTCCG AGGCCCGGAATAGCGCATTTGGGTTTCAAGGCAGGCTG CTGCACCTGTCTGCCGGCCAGAGGCTGGGAGTGCATCTG CACACAGAGGCCAGGGCTAGACACGCCTGGCAGCTGAC ACAGGGCGCTACAGTGCTGGGCCTGTTCAGAGTGACCC CCGAGATTCCAGCCGGCCTGGGCGGAGGCGGATCTGGC GGCGGAGGATCTAGAGAGGGACCCGAACTGTCCCCTGA CGATCCAGCCGGGCTGCTGGATCTGAGACAGGGAATGT TCGCCCAGCTGGTGGCTCAGAATGTGCTGCTGATTGACG GACCTCTGAGCTGGTACTCCGACCCAGGGCTGGCAGGG GTGTCCCTGACTGGGGGACTGTCCTACAAAGAAGATAC AAAAGAACTGGTGGTGGCTAAAGCTGGGGTGTACTATG TGTTTTTTCAGCTGGAACTGAGGCGGGTGGTGGCTGGGG AGGGCTCAGGATCTGTGTCCCTGGCTCTGCATCTGCAGC CACTGCGCTCTGCTGCTGGCGCAGCTGCACTGGCTCTGA CTGTGGACCTGCCACCAGCCTCTAGCGAGGCCAGAAAC AGCGCCTTCGGGTTCCAAGGACGCCTGCTGCATCTGAGC GCCGGACAGCGCCTGGGAGTGCATCTGCATACTGAAGC CAGAGCCCGGCATGCTTGGCAGCTGACTCAGGGGCAA CTGTGCTGGGACTGTTTCGCGTGACACCTGAGATCCCTG CCGGACTG |
| 176 | nucleotide sequence anti-FAP (4B9) Fc knob chain fused to monomeric hu 4-1BBL (71-248) | GAGGTGCAGCTGCTCGAAAGCGGCGGAGGACTGGTGCA GCCTGGCGGCAGCCTGAGACTGTCTTGCGCCGCCAGCG GCTTCACCTTCAGCAGCTACGCCATGAGCTGGGTCCGCC AGGCCCCTGGCAAGGGACTGGAATGGGTGTCCGCCATC ATCGGCTCTGGCGCCAGCACCTACTACGCCGACAGCGTG AAGGGCCGGTTCACCATCAGCCGGGACAACAGCAAGAA CACCCTGTACCTGCAGATGAACAGCCTGCGGGCCGAGG ACACCGCCGTGTACTACTGCGCCAAGGGATGGTTCGGC |

TABLE 26-continued

Sequences of bivalent FAP(4B9)-targeted human 4-1BB ligand
(71-248) containing Fc (kih) fusion molecule Construct 2.6

| SEQ ID NO: | Description | Sequence |
|---|---|---|
| | | GGCTTCAACTACTGGGGACAGGGCACCCTGGTCACAGT
GTCCAGCGCTAGCACCAAGGGCCCATCGGTCTTCCCCCT
GGCACCCTCCTCCAAGAGCACCTCTGGGGGCACAGCGG
CCCTGGGCTGCCTGGTCAAGGACTACTTCCCCGAACCGG
TGACGGTGTCGTGGAACTCAGGCGCCCTGACCAGCGGC
GTGCACACCTTCCCGGCTGTCCTACAGTCCTCAGGACTC
TACTCCCTCAGCAGCGTGGTGACCGTGCCCTCCAGCAGC
TTGGGCACCCAGACCTACATCTGCAACGTGAATCACAA
GCCCAGCAACACCAAGGTGGACAAGAAAGTTGAGCCCA
AATCTTGTGACAAAACTCACACATGCCCACCGTGCCCAG
CACCTGAAGCTGCAGGGGGACCGTCAGTCTTCCTCTTCC
CCCCAAAACCCAAGGACACCCTCATGATCTCCCGGACCC
CTGAGGTCACATGCGTGGTGGTGGACGTGAGCCACGAA
GACCCTGAGGTCAAGTTCAACTGGTACGTGGACGGCGT
GGAGGTGCATAATGCCAAGACAAAGCCGCGGGAGGAGC
AGTACAACAGCACGTACCGTGTGGTCAGCGTCCTCACCG
TCCTGCACCAGGACTGGCTGAATGGCAAGGAGTACAAG
TGCAAGGTCTCCAACAAAGCCCTCGGCGCCCCCATCGA
GAAAACCATCTCCAAAGCCAAAGGGCAGCCCCGAGAAC
CACAGGTGTACACCCTGCCCCCCTGCAGAGATGAGCTG
ACCAAGAACCAGGTGTCCCTGTGGTGTCTGGTCAAGGGC
TTCTACCCCAGCGATATCGCCGTGGAGTGGGAGAGCAA
CGGCCAGCCTGAGAACAACTACAAGACCACCCCCCCTG
TGCTGGACAGCGACGGCAGCTTCTTCCTGTACTCCAAAC
TGACCGTGGACAAGAGCCGGTGGCAGCAGGGCAACGTG
TTCAGCTGCAGCGTGATGCACGAGGCCCTGCACAACCA
CTACACCCAGAAGTCCCTGAGCCTGAGCCCCGGCGGAG
GCGGCGGAAGCGGAGGAGGAGGATCCAGAGAGGGCCC
TGAGCTGAGCCCCGATGATCCTGCTGGACTGCTGGACCT
GCGGCAGGGCATGTTTGCTCAGCTGGTGGCCCAGAACGT
GCTGCTGATCGATGGCCCCCTGTCCTGGTACAGCGATCC
TGGACTGGCTGGCGTGTCACTGACAGGCGGCCTGAGCTA
CAAAGAGGACACCAAAGAACTGGTGGTGGCCAAGGCCG
GCGTGTACTACGTGTTCTTTCAGCTGGAACTGCGGAGAG
TGGTGGCCGGCGAAGGATCTGGCTCTGTGTCTCTGGCCC
TGCATCTGCAGCCTCTGAGAAGCGCTGCTGGCGCTGCAG
CTCTGGCACTGACAGTGGATCTGCCTCCTGCCAGCTCCG
AGGCCCGGAATAGCGCATTTGGGTTTCAAGGCAGGCTG
CTGCACCTGTCTGCCGGCCAGAGGCTGGGAGTGCATCTG
CACACAGAGGCCAGGGCTAGACACGCCTGGCAGCTGAC
ACAGGGCGCTACAGTGCTGGGCCTGTTCAGAGTGACCC
CCGAGATTCCAGCCGGCCTG |
| 163 | anti-FAP (4B9) light chain | see Table 21 |
| 126 | anti-FAP (4B9) Fc hole chain fused to dimeric hu 4-1BBL (71-248) | EVQLLESGGGLVQPGGSLRLSCAASGFTFSSYAMSWVRQA
PGKGLEWVSAIIGSGASTYYADSVKGRFTISRDNSKNTLYL
QMNSLRAEDTAVYYCAKGWFGGFNYWGQGTLVTVSSAS
TKGPSVFPLAPSSKSTSGGTAALGCLVKDYFPEPVTVSWNS
GALTSGVHTFPAVLQSSGLYSLSSVVTVPSSSLGTQTYICN
VNHKPSNTKVDKKVEPKSCDKTHTCPPCPAPEAAGGPSVF
LFPPKPKDTLMISRTPEVTCVVVDVSHEDPEVKFNWYVDG
VEVHNAKTKPREEQYNSTYRVVSVLTVLHQDWLNGKEYK
CKVSNKALGAPIEKTISKAKGQPREPQVCTLPPSRDELTKN
QVSLSCAVKGFYPSDIAVEWESNGQPENNYKTTPPVLDSD
GSFFLVSKLTVDKSRWQQGNVFSCSVMHEALHNHYTQKS
LSLSPGGGGSGGGGSREGPELSPDDPAGLLDLRQGMFAQ
LVAQNVLLIDGPLSWYSDPGLAGVSLTGGLSYKEDTKELV
VAKAGVYYVFFQLELRRVVAGEGSGSVSLALHLQPLRSAA
GAAALALTVDLPPASSEARNSAFGFQGRLLHLSAGQRLGV
HLHTEARARHAWQLTQGATVLGLFRVTPEIPAGLGGGGSG
GGGSREGPELSPDDPAGLLDLRQGMFAQLVAQNVLLIDGP
LSWYSDPGLAGVSLTGGLSYKEDTKELVVAKAGVYYVFF
QLELRRVVAGEGSGSVSLALHLQPLRSAAGAAALALTVDL
PPASSEARNSAFGFQGRLLHLSAGQRLGVHLHTEARARHA
WQLTQGATVLGLFRVTPEIPAGL |
| 127 | anti-FAP (4B9) Fc knob chain fused to monomeric hu 4-1BBL (71-248) | EVQLLESGGGLVQPGGSLRLSCAASGFTFSSYAMSWVRQA
PGKGLEWVSAIIGSGASTYYADSVKGRFTISRDNSKNTLYL
QMNSLRAEDTAVYYCAKGWFGGFNYWGQGTLVTVSSAS
TKGPSVFPLAPSSKSTSGGTAALGCLVKDYFPEPVTVSWNS
GALTSGVHTFPAVLQSSGLYSLSSVVTVPSSSLGTQTYICN
VNHKPSNTKVDKKVEPKSCDKTHTCPPCPAPEAAGGPSVF |

TABLE 26-continued

Sequences of bivalent FAP(4B9)-targeted human 4-1BB ligand
(71-248) containing Fc (kih) fusion molecule Construct 2.6

| SEQ ID NO: | Description | Sequence |
|---|---|---|
|  |  | LFPPKPKDTLMISRTPEVTCVVVDVSHEDPEVKFNWYVDG VEVHNAKTKPREEQYNSTYRVVSVLTVLHQDWLNGKEYK CKVSNKALGAPIEKTISKAKGQPREPQVYTLPPCRDELTKN QVSLWCLVKGFYPSDIAVEWESNGQPENNYKTTPPVLDSD GSFFLYSKLTVDKSRWQQGNVFSCSVMHEALHNHYTQKS LSLSPGGGGSGGGGSREGPELSPDDPAGLLDLRQGMFAQ LVAQNVLLIDGPLSWYSDPGLAGVSLTGGLSYKEDTKELV VAKAGVYYVFFQLELRRVVAGEGSGSVSLALHLQPLRSAA GAAALALTVDLPPASSEARNSAFGFQGRLLHLSAGQRLGV HLHTEARARHAWQLTQGATVLGLFRVTPEIPAGL |
| 125 | anti-FAP (4B9) light chain | see Table 21 |

2.2 Preparation of Untargeted Human 4-1BB Ligand Trimer-Containing Fc Fusion Antigen Binding Molecules (Control Molecules)

Further control molecules were prepared as described in Example 1.4 above for Control A and B. A bivalent variant Control C was prepared in analogy to the bivalent Construct 2.3 and 2.6 and a monovalent variant Control E was prepared in analogy to Construct 2.5 (containing a 4-1BB ligand (71-248) trimer), with the only difference that the anti-FAP binder (VH-VL) was replaced by a germline control, termed DP47, not binding to the antigen.

Table 27 shows the cDNA and amino acid sequences of the bivalent DP47-untargeted split trimeric 4-1BB ligand (71-254) Fc (kih) fusion molecule Control C. Table 28 shows the cDNA and amino acid sequences of the monovalent DP47-untargeted split trimeric 4-1BB ligand (71-248) Fc (kih) fusion molecule Control E.

TABLE 27

Sequences of bivalent DP47-untargeted human 4-1BB ligand
(71-254) containing Fc (kih) fusion molecule Control C

| SEQ ID NO: | Description | Sequence |
|---|---|---|
| 177 | nucleotide sequence DP47 Fc hole chain fused to dimeric hu 4-1BBL (71-254) | GAGGTGCAATTGTTGGAGTCTGGGGGAGGCTTGGTACA GCCTGGGGGGTCCCTGAGACTCTCCTGTGCAGCCTCCGG ATTCACCTTTAGCAGTTATGCCATGAGCTGGGTCCGCCA GGCTCCAGGGAAGGGGCTGGAGTGGGTCTCAGCTATTA GTGGTAGTGGTGGTAGCACATACTACGCAGACTCCGTGA AGGGCCGGTTCACCATCTCCAGAGACAATTCCAAGAAC ACGCTGTATCTGCAGATGAACAGCCTGAGAGCCGAGGA CACGGCCGTATATTACTGTGCGAAAGGCAGCGGATTTGA CTACTGGGGCCAAGGAACCCTGGTCACCGTCTCGAGTGC TAGCACCAAGGGCCCCTCCGTGTTCCCCCTGGCCCCCAG CAGCAAGAGCACCAGCGGCGGCACAGCCGCTCTGGGCT GCCTGGTCAAGGACTACTTCCCCGAGCCCGTGACCGTGT CCTGGAACAGCGGAGCCCTGACCTCCGGCGTGCACACC TTCCCCGCCGTGCTGCAGAGTTCTGGCCTGTATAGCCTG AGCAGCGTGGTCACCGTGCCTTCTAGCAGCCTGGGCACC CAGACCTACATCTGCAACGTGAACCACAAGCCCAGCAA CACCAAGGTGGACAAGAAGGTGGAGCCCAAGAGCTGCG ACAAAACTCACACATGCCCACCGTGCCCAGCACCTGAA GCTGCAGGGGACCGTCAGTCTTCCTCTTCCCCCCAAAA CCCAAGGACACCCTCATGATCTCCCGGACCCCTGAGGTC ACATGCGTGGTGGTGGACGTGAGCCACGAAGACCCTGA GGTCAAGTTCAACTGGTACGTGGACGGCGTGGAGGTGC ATAATGCCAAGACAAAGCCGCGGGAGGAGCAGTACAAC AGCACGTACCGTGTGGTCAGCGTCCTCACCGTCCTGCAC CAGGACTGGCTGAATGGCAAGGAGTACAAGTGCAAGGT CTCCAACAAAGCCCTCGGCGCCCCCATCGAGAAAACCA TCTCCAAAGCCAAAGGGCAGCCCCGAGAACCACAGGTG TGCACCCTGCCCCCATCCCGGGATGAGCTGACCAAGAA CCAGGTCAGCCTCTCGTGCGCAGTCAAAGGCTTCTATCC CAGCGACATCGCCGTGGAGTGGGAGAGCAATGGGCAGC CGGAGAACAACTACAAGACCACGCCTCCCGTGCTGGAC TCCGACGGCTCCTTCTTCCTCGTGAGCAAGCTCACCGTG GACAAGAGCAGGTGGCAGCAGGGGAACGTCTTCTCATG CTCCGTGATGCATGAGGCTCTGCACAACCACTACACGCA GAAGAGCCTCTCCCTGTCTCCGGGTGGAGGCGGCGGAA GCGGAGGAGGAGGATCCAGAGAGGGCCCTGAGCTGAGC CCCGATGATCCTGCTGGACTGCTGGACCTGCGGCAGGGC ATGTTTGCTCAGCTGGTGGCCCAGAACGTGCTGCTGATC |

TABLE 27-continued

Sequences of bivalent DP47-untargeted human 4-1BB ligand
(71-254) containing Fc (kih) fusion molecule Control C

| SEQ ID NO: | Description | Sequence |
|---|---|---|
| | | GATGGCCCCTGTCCTGGTACAGCGATCCTGGACTGGCT<br>GGCGTGTCACTGACAGGCGGCCTGAGCTACAAAGAGGA<br>CACCAAAGAACTGGTGGTGGCCAAGGCCGGCGTGTACT<br>ACGTGTTCTTTCAGCTGGAACTGCGGAGAGTGGTGGCCG<br>GCGAAGGATCTGGCTCTGTGTCTCTGGCCCTGCATCTGC<br>AGCCTCTGAGAAGCGCTGCTGGCGCTGCAGCTCTGGCAC<br>TGACAGTGGATCTGCCTCCTGCCAGCTCCGAGGCCCGGA<br>ATAGCGCATTTGGGTTTCAAGGCAGGCTGCTGCACCTGT<br>CTGCCGGCCAGAGGCTGGGAGTGCATCTGCACACAGAG<br>GCCAGGGCTAGACACGCCTGGCAGCTGACACAGGGCGC<br>TACAGTGCTGGGCCTGTTCAGAGTGACCCCCGAGATTCC<br>AGCCGGCCTGCCTTCTCCAAGAAGCGAAGGCGGAGGCG<br>GATCTGGCGGCGGAGGATCTAGAGAGGGACCCGAACTG<br>TCCCCTGACGATCCAGCCGGGCTGCTGGATCTGAGACAG<br>GGAATGTTCGCCCAGCTGGTGGCTCAGAATGTGCTGCTG<br>ATTGACGGACCTCTGAGCTGGTACTCCGACCCAGGGCTG<br>GCAGGGGTGTCCCTGACTGGGGACTGTCCTACAAAGA<br>AGATACAAAAGAACTGGTGGTGGCTAAAGCTGGGGTGT<br>ACTATGTGTTTTTTCAGCTGGAACTGAGGCGGGTGGTGG<br>CTGGGGAGGGCTCAGGATCTGTGTCCCTGGCTCTGCATC<br>TGCAGCCACTGCGCTCTGCTGCTGGCGCAGCTGCACTGG<br>CTCTGACTGTGGACCTGCCACCAGCCTCTAGCGAGGCCA<br>GAAACAGCGCCTTCGGGTTCCAAGGACGCCTGCTGCATC<br>TGAGCGCCGGACAGCGCCTGGGAGTGCATCTGCATACT<br>GAAGCCAGAGCCCGGCATGCTTGGCAGCTGACTCAGGG<br>GGCAACTGTGCTGGGACTGTTTCGCGTGACACCTGAGAT<br>CCCTGCCGGACTGCCAAGCCCTAGATCAGAA |
| 178 | nucleotide sequence DP47 Fc knob chain fused to monomeric hu 4-1BBL (71-254) | GAGGTGCAATTGTTGGAGTCTGGGGGAGGCTTGGTACA<br>GCCTGGGGGGTCCCTGAGACTCTCCTGTGCAGCCTCCGG<br>ATTCACCTTTAGCAGTTATGCCATGAGCTGGGTCCGCCA<br>GGCTCCAGGGAAGGGGCTGGAGTGGGTCTCAGCTATTA<br>GTGGTAGTGGTGGTAGCACATACTACGCAGACTCCGTGA<br>AGGGCCGGTTCACCATCTCCAGAGACAATTCCAAGAAC<br>ACGCTGTATCTGCAGATGAACAGCCTGAGAGCCGAGGA<br>CACGGCCGTATATTACTGTGCGAAAGGCAGCGGATTTGA<br>CTACTGGGGCCAAGGAACCCTGGTCACCGTCTCGAGTGC<br>TAGCACCAAGGGCCCATCGGTCTTCCCCCTGGCACCCTC<br>CTCCAAGAGCACCTCTGGGGGCACAGCGGCCCTGGGCT<br>GCCTGGTCAAGGACTACTTCCCCGAACCGGTGACGGTGT<br>CGTGGAACTCAGGCGCCCTGACCAGCGGCGTGCACACC<br>TTCCCGGCTGTCCTACAGTCCTCAGGACTCTACTCCCTC<br>AGCAGCGTGGTGACCGTGCCCTCCAGCAGCTTGGGCAC<br>CCAGACCTACATCTGCAACGTGAATCACAAGCCCAGCA<br>ACACCAAGGTGGACAAGAAAGTTGAGCCCAAATCTTGT<br>GACAAAACTCACACATGCCCACCGTGCCCAGCACCTGA<br>AGCTGCAGGGGACCGTCAGTCTTCCTCTTCCCCCCAAA<br>ACCCAAGGACACCCTCATGATCTCCCGGACCCCTGAGGT<br>CACATGCGTGGTGGTGGACGTGAGCCACGAAGACCCTG<br>AGGTCAAGTTCAACTGGTACGTGGACGGCGTGGAGGTG<br>CATAATGCCAAGACAAAGCCGCGGGAGGAGCAGTACAA<br>CAGCACGTACCGTGTGGTCAGCGTCCTCACCGTCCTGCA<br>CCAGGACTGGCTGAATGGCAAGGAGTACAAGTGCAAGG<br>TCTCCAACAAAGCCCTCGGCGCCCCCATCGAGAAAACC<br>ATCTCCAAAGCCAAAGGGCAGCCCCGAGAACCACAGGT<br>GTACACCCTGCCCCCCTGCAGAGATGAGCTGACCAAGA<br>ACCAGGTGTCCCTGTGGTGTCTGGTCAAGGGCTTCTACC<br>CCAGCGATATCGCCGTGGAGTGGGAGAGCAACGGCCAG<br>CCTGAGAACAACTACAAGACCACCCCCCCTGTGCTGGA<br>CAGCGACGGCAGCTTCTTCCTGTACTCCAAACTGACCGT<br>GGACAAGAGCCGGTGGCAGCAGGGCAACGTGTTCAGCT<br>GCAGCGTGATGCACGAGGCCCTGCACAACCACTACACC<br>CAGAAGTCCCTGAGCCTGAGCCCCGGCGGAGGCGGCGG<br>AAGCGGAGGAGGAGGATCCAGAGAGGGCCCTGAGCTGA<br>GCCCCGATGATCCTGCTGGACTGCTGGACCTGCGGCAGG<br>GCATGTTTGCTCAGCTGGTGGCCCAGAACGTGCTGCTGA<br>TCGATGGCCCCTGTCCTGGTACAGCGATCCTGGACTGG<br>CTGGCGTGTCACTGACAGGCGGCCTGAGCTACAAAGAG<br>GACACCAAAGAACTGGTGGTGGCCAAGGCCGGCGTGTA<br>CTACGTGTTCTTTCAGCTGGAACTGCGGAGAGTGGTGGC<br>CGGCGAAGGATCTGGCTCTGTGTCTCTGGCCCTGCATCT<br>GCAGCCTCTGAGAAGCGCTGCTGGCGCTGCAGCTCTGGC<br>ACTGACAGTGGATCTGCCTCCTGCCAGCTCCGAGGCCCG<br>GAATAGCGCATTTGGGTTTCAAGGCAGGCTGCTGCACCT |

TABLE 27-continued

Sequences of bivalent DP47-untargeted human 4-1BB ligand (71-254) containing Fc (kih) fusion molecule Control C

| SEQ ID NO: | Description | Sequence |
|---|---|---|
| | | GTCTGCCGGCCAGAGGCTGGGAGTGCATCTGCACACAG AGGCCAGGGCTAGACACGCCTGGCAGCTGACACAGGGC GCTACAGTGCTGGGCCTGTTCAGAGTGACCCCCGAGATT CCAGCCGGCCTGCCTTCTCCAAGAAGCGAA |
| 80 | nucleotide sequence DP47 light chain | see Table 18 |
| 179 | DP47 Fc hole chain fused to dimeric hu 4-1BBL (71-254) | EVQLLESGGGLVQPGGSLRLSCAASGFTFSSYAMSWVRQA PGKGLEWVSAIIGSGASTYYADSVKGRFTISRDNSKNTLYL QMNSLRAEDTAVYYCAKGWFGGFNYWGQGTLVTVSSAS TKGPSVFPLAPSSKSTSGGTAALGCLVKDYFPEPVTVSWNS GALTSGVHTFPAVLQSSGLYSLSSVVTVPSSSLGTQTYICN VNHKPSNTKVDKKVEPKSCDKTHTCPPCPAPEAAGGPSVF LFPPKPKDTLMISRTPEVTCVVVDVSHEDPEVKFNWYVDG VEVHNAKTKPREEQYNSTYRVVSVLTVLHQDWLNGKEYK CKVSNKALGAPIEKTISKAKGQPREPQVCTLPPSRDELTKN QVSLSCAVKGFYPSDIAVEWESNGQPENNYKTTPPVLDSD GSFFLVSKLTVDKSRWQQGNVFSCSVMHEALHNHYTQKS LSLSPGGGGSGGGGSREGPELSPDDPAGLLDLRQGMFAQ LVAQNVLLIDGPLSWYSDPGLAGVSLTGGLSYKEDTKELV VAKAGVYYVFFQLELRRVVAGEGSGSVSLALHLQPLRSAA GAAALALTVDLPPASSEARNSAFGFQGRLLHLSAGQRLGV HLHTEARARHAWQLTQGATVLGLFRVTPEIPAGLPSPRSEG GGGSGGGGSREGPELSPDDPAGLLDLRQGMFAQLVAQNV LLIDGPLSWYSDPGLAGVSLTGGLSYKEDTKELVVAKAGV YYVFFQLELRRVVAGEGSGSVSLALHLQPLRSAAGAAALA LTVDLPPASSEARNSAFGFQGRLLHLSAGQRLGVHLHTEA RARHAWQLTQGATVLGLFRVTPEIPAGLPSPRSE |
| 180 | DP47 Fc knob chain fused to monomeric hu 4-1BBL (71-254) | EVQLLESGGGLVQPGGSLRLSCAASGFTFSSYAMSWVRQA PGKGLEWVSAIIGSGASTYYADSVKGRFTISRDNSKNTLYL QMNSLRAEDTAVYYCAKGWFGGFNYWGQGTLVTVSSAS TKGPSVFPLAPSSKSTSGGTAALGCLVKDYFPEPVTVSWNS GALTSGVHTFPAVLQSSGLYSLSSVVTVPSSSLGTQTYICN VNHKPSNTKVDKKVEPKSCDKTHTCPPCPAPEAAGGPSVF LFPPKPKDTLMISRTPEVTCVVVDVSHEDPEVKFNWYVDG VEVHNAKTKPREEQYNSTYRVVSVLTVLHQDWLNGKEYK CKVSNKALGAPIEKTISKAKGQPREPQVYTLPPCRDELTKN QVSLWCLVKGFYPSDIAVEWESNGQPENNYKTTPPVLDSD GSFFLYSKLTVDKSRWQQGNVFSCSVMHEALHNHYTQKS LSLSPGGGGSGGGGSREGPELSPDDPAGLLDLRQGMFAQ LVAQNVLLIDGPLSWYSDPGLAGVSLTGGLSYKEDTKELV VAKAGVYYVFFQLELRRVVAGEGSGSVSLALHLQPLRSAA GAAALALTVDLPPASSEARNSAFGFQGRLLHLSAGQRLGV HLHTEARARHAWQLTQGATVLGLFRVTPEIPAGLPSPRSE |
| 82 | DP47 light chain | see Table 18 |

TABLE 28

Sequences of monovalent untargeted human 4-1BB ligand (71-248) containing Fc (kih) fusion molecule Control E

| SEQ ID NO: | Description | Sequence |
|---|---|---|
| 171 | Dimeric hu 4-1BBL (71-248) - CL Fc knob chain | see Table 25 |
| 172 | Monomeric hu 4-1BBL (71-248) - CH1 | see Table 25 |
| 79 | DP47 Fc hole chain | see Table 18 |
| 80 | DP47 light chain | see Table 18 |
| 173 | Dimeric hu 4-1BBL (71-248) - CL Fc knob chain | see Table 25 |
| 174 | Monomeric hu 4-1BBL (71-248) - CH1 | see Table 25 |
| 81 | DP47 Fc hole chain | see Table 18 |
| 82 | DP47 light chain | see Table 18 |

2.3 Preparation of Untargeted Human IgG1 as Control F

An additional control molecule used in the assays was an untargeted DP47, germline control, human IgG1, containing the Pro329Gly, Leu234Ala and Leu235Ala mutations, to abrogate binding to Fc gamma receptors according to the method described in International Patent Appl. Publ. No. WO 2012/130831).

Table 29 shows the cDNA and amino acid sequences of the cDNA and amino acid sequences of the untargeted DP47 huIgG1 PGLALA (Control F).

The split trimeric 4-1BB ligand Fc (kih) fusion was produced by co-transfecting HEK293-EBNA cells with the mammalian expression vectors using polyethylenimine. The cells were transfected with the corresponding expression vectors. For Constructs 2.1, 2.2, 2.4 and 2.5 and corresponding control molecules, a 1:1:1:1 ratio (e.g. "vector dimeric

TABLE 29

Sequences of untargeted DP47 huIgG1 (Control F)

| SEQ ID NO: | Description | Sequence |
|---|---|---|
| 181 | nucleotide sequence DP47 heavy chain (hu IgG1 PGLALA) | GAGGTGCAATTGTTGGAGTCTGGGGGAGGCTTGGTACA GCCTGGGGGGTCCCTGAGACTCTCCTGTGCAGCCTCCGG ATTCACCTTTAGCAGTTATGCCATGAGCTGGGTCCGCCA GGCTCCAGGGAAGGGGCTGGAGTGGGTCTCAGCTATTA GTGGTAGTGGTGGTAGCACATACTACGCAGACTCCGTGA AGGGCCGGTTCACCATCTCCAGAGACAATTCCAAGAAC ACGCTGTATCTGCAGATGAACAGCCTGAGAGCCGAGGA CACGGCCGTATATTACTGTGCGAAAGGCAGCGGATTTGA CTACTGGGGCCAAGGAACCCTGGTCACCGTCTCGAGTGC TAGCACCAAGGGCCCATCGGTCTTCCCCCTGGCACCCTC CTCCAAGAGCACCTCTGGGGGCACAGCGGCCCTGGGCT GCCTGGTCAAGGACTACTTCCCCGAACCGGTGACGGTGT CGTGGAACTCAGGCGCCCTGACCAGCGGCGTGCACACC TTCCCGGCTGTCCTACAGTCCTCAGGACTCTACTCCCTC AGCAGCGTGGTGACCGTGCCCTCCAGCAGCTTGGGCAC CCAGACCTACATCTGCAACGTGAATCACAAGCCCAGCA ACACCAAGGTGGACAAGAAAGTTGAGCCCAAATCTTGT GACAAAACTCACACATGCCCACCGTGCCCAGCACCTGA AGCTGCAGGGGGACCGTCAGTCTTCCTCTTCCCCCCAAA ACCCAAGGACACCCTCATGATCTCCCGGACCCCTGAGGT CACATGCGTGGTGGTGGACGTGAGCCACGAAGACCCTG AGGTCAAGTTCAACTGGTACGTGGACGGCGTGGAGGTG CATAATGCCAAGACAAAGCCGCGGGAGGAGCAGTACAA CAGCACGTACCGTGTGGTCAGCGTCCTCACCGTCCTGCA CCAGGACTGGCTGAATGGCAAGGAGTACAAGTGCAAGG TCTCCAACAAAGCCCTCGGCGCCCCCATCGAGAAAACC ATCTCCAAAGCCAAAGGGCAGCCCCGAGAACCACAGGT GTACACCCTGCCCCCATCCCGGGATGAGCTGACCAAGA ACCAGGTCAGCCTGACCTGCCTGGTCAAAGGCTTCTATC CCAGCGACATCGCCGTGGAGTGGGAGAGCAATGGGCAG CCGGAGAACAACTACAAGACCACGCCTCCCGTGCTGGA CTCCGACGGCTCCTTCTTCCTCTACAGCAAGCTCACCGT GGACAAGAGCAGGTGGCAGCAGGGGAACGTCTTCTCAT GCTCCGTGATGCATGAGGCTCTGCACAACCACTACACGC AGAAGAGCCTCTCCCTGTCTCCGGGTAAA |
| 80 | DP47 light chain | see Table 18 |
| 182 | DP47 heavy chain (hu IgG1 PGLALA) | EVQLLESGGGLVQPGGSLRLSCAASGFTFSSYAMSWVRQA PGKGLEWVSAISGSGGSTYYADSVKGRFTISRDNSKNTLYL QMNSLRAEDTAVYYCAKGSGFDYWGQGTLVTVSSASTKG PSVFPLAPSSKSTSGGTAALGCLVKDYFPEPVTVSWNSGAL TSGVHTFPAVLQSSGLYSLSSVVTVPSSSLGTQTYICNVNH KPSNTKVDKKVEPKSCDKTHTCPPCPAPEAAGGPSVFLFPP KPKDTLMISRTPEVTCVVVDVSHEDPEVKFNWYVDGVEV HNAKTKPREEQYNSTYRVVSVLTVLHQDWLNGKEYKCKV SNKALGAPIEKTISKAKGQPREPQVYTLPPSRDELTKNQVS LTCLVKGFYPSDIAVEWESNGQPENNYKTTPPVLDSDGSFF LYSKLTVDKSRWQQGNVFSCSVMHEALHNHYTQKSLSLS PGK |
| 82 | DP47 light chain | see Table 18 |

2.4 Production of Monovalent and Bivalent FAP (4B9) Targeted Split Trimeric 4-1BB Ligand Fc Fusion Constructs and Control Molecules The targeted and untargeted split trimeric 4-1BB ligand Fc (kih) fusion encoding sequences were cloned into a plasmid vector, which drives expression of the insert from an MPSV promoter and contains a synthetic polyA sequence located at the 3' end of the CDS. In addition, the vector contains an EBV OriP sequence for episomal maintenance of the plasmid.

ligand-CL-knob chain":"vector monomeric ligand fusion-CH1":"vector anti-FAP Fab-hole chain":"vector anti-FAP light chain") was used. For Constructs 2.3 and 2.6 and its control molecule, a 1:1:1 ratio ("vector huIgG1 Fc hole dimeric ligand chain":"vector huIgG1 Fc knob monomeric ligand chain":"vector anti-FAP light chain") was taken. Human IgGs, used as control in the assay, were produced as for the bispecific constructs (for transfection only a vector for light and a vector for heavy chain were used.

For production in 500 mL shake flasks, 300 million HEK293 EBNA cells were seeded 24 hours before transfection. For transfection cells were centrifuged for 10 minutes at 210×g, and the supernatant was replaced by 20 mL pre-warmed CD CHO medium. Expression vectors (200 μg of total DNA) were mixed in 20 mL CD CHO medium. After addition of 540 μL PEI, the solution was vortexed for 15 seconds and incubated for 10 minutes at room temperature. Afterwards, cells were mixed with the DNA/PEI solution, transferred to a 500 mL shake flask and incubated for 3 hours at 37° C. in an incubator with a 5% $CO_2$ atmosphere. After the incubation, 160 mL of Excell medium supplemented with 6 mM L-Glutamine, 5 g/L PEPSOY and 1.2 mM valproic acid was added and cells were cultured for 24 hours. One day after transfection 12% Feed 7 and Glucose (final conc. 3 g/L) were added. After culturing for 7 days, the supernatant was collected by centrifugation for 30-40 minutes at least 400×g. The solution was sterile filtered (0.22 μm filter), supplemented with sodium azide to a final concentration of 0.01% (w/v), and kept at 4° C.

The targeted and untargeted TNF ligand trimer-containing Fc (kih) fusion antigen binding molecules and the human IgG1 were purified from cell culture supernatants by affinity chromatography using Protein A, followed by size exclusion chromatography. For affinity chromatography, the supernatant was loaded on a MAB SELECT SURE® column (CV=5-15 mL, resin from GE Healthcare) equilibrated with Sodium Phosphate (20 mM), Sodium Citrate (20 mM) buffer (pH 7.5). Unbound protein was removed by washing with at least 6 column volumes of the same buffer. The bound protein was eluted using either a linear gradient (20 CV) or a step elution (8 CV) with 20 mM sodium citrate, 100 mM Sodium chloride, 100 mM Glycine buffer (pH 3.0). For the linear gradient an additional 4 column volumes step elution was applied.

The pH of collected fractions was adjusted by adding 1/10 (v/v) of 0.5M sodium phosphate, pH8.0. The protein was concentrated prior to loading on a HILOAD® Superdex 200 column (GE Healthcare) equilibrated with 20 mM Histidine, 140 mM sodium chloride, 0.01% (v/v) TWEEN® 20 (polysorbate 20) solution of pH 6.0.

The protein concentration was determined by measuring the optical density (OD) at 280 nm, using a molar extinction coefficient calculated on the basis of the amino acid sequence. Purity and molecular weight of the targeted trimeric 4-1BB ligand Fc (kih) fusion was analyzed by SDS-PAGE in the presence and absence of a reducing agent (5 mM 1,4-dithiothreitol) and staining with Coomassie SIMPLYBLUE™ SafeStain (Invitrogen USA) or CE-SDS using Caliper LabChip GXII (Perkin Elmer). The aggregate content of samples was analyzed using a TSKGEL® G3000 SW XL analytical size-exclusion column (Tosoh) equilibrated in 25 mM $K_2HPO_4$, 125 mM NaCl, 200 mM L-Arginine Monohydrocloride, 0.02% (w/v) NaN3, pH 6.7 running buffer at 25° C.

Table 30 summarizes the yield and final monomer content of the FAP (4B9) targeted and untargeted 4-1BB ligand trimer-containing Fc (kih) fusion antigen binding molecules and control molecules.

TABLE 30

Biochemical analysis of FAP (4B9) targeted and untargeted 4-1BB ligand trimer-containing Fc (kih) fusion antigen binding molecules and control molecules

| Construct | Monomer [%] (SEC) | Yield [mg/l] |
|---|---|---|
| Construct 2.1 | 95 | 15.8 |
| Construct 2.3 | 97 | 11.5 |
| Construct 2.4 | 97 | 14.1 |
| Construct 2.5 | 100 | 16.5 |
| Control C (bivalent) | 98 | 12.6 |
| Control E (monovalent) | 93 | 4.1 |
| Control F (germline DP47 human IgG1 PGLALA | 100 | 50 |

Example 3

Preparation, Purification and Characterization of 4-1BB

Figure 5C:
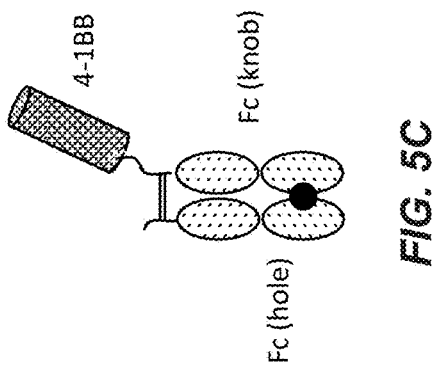
FIG. 5C is a drawing of the monomeric 4-1BB Fc(kih) construct as prepared in Example 3.

DNA sequences encoding the ectodomains of human, mouse or cynomolgus 4-1BB (Table 31) were subcloned in frame with the human IgG1 heavy chain CH2 and CH3 domains on the knob (Merchant et al., 1998). An AcTEV protease cleavage site was introduced between an antigen ectodomain and the Fc of human IgG1. An Avi tag for directed biotinylation was introduced at the C-terminus of the antigen-Fc knob. Combination of the antigen-Fc knob chain containing the S354C/T366W mutations, with a Fc hole chain containing the Y349C/T366S/L368A/Y407V mutations allows generation of a heterodimer which includes a single copy of 4-1BB ectodomain containing chain, thus creating a monomeric form of Fc-linked antigen (FIG. 5C). Table 32 shows the cDNA and amino acid sequences of the antigen Fc-fusion constructs.

TABLE 31

Amino acid numbering of antigen ectodomains (ECD) and their origin

| SEQ ID NO: | Construct | Origin | ECD |
|---|---|---|---|
| 83 | human 4-1BB ECD | Synthetized according to Q07011 | aa 24-186 |
| 84 | cynomolgus 4-1BB ECD | isolated from cynomolgus blood | aa 24-186 |
| 85 | murine 4-1BB ECD | Synthetized according to P20334 | aa 24-187 |

TABLE 32 cDNA and Amino acid sequences of monomeric antigen Fc(kih) fusion molecules

| SEQ ID NO: | Antigen | Sequence |
|---|---|---|
| 86 | Nucleotide sequence Fc hole chain | GACAAAACTCACACATGCCCACCGTGCCCAGCACCTGA ACTCCTGGGGGGACCGTCAGTCTTCCTCTTCCCCCCAAA ACCCAAGGACACCCTCATGATCTCCCGGACCCCTGAGGT CACATGCGTGGTGGTGGACGTGAGCCACGAAGACCCTG AGGTCAAGTTCAACTGGTACGTGGACGGCGTGGAGGTG |

TABLE 32-continued cDNA and Amino acid sequences of monomeric antigen Fc(kih) fusion molecules

| SEQ ID NO: | Antigen | Sequence |
|---|---|---|
| | | CATAATGCCAAGACAAAGCCGCGGGAGGAGCAGTACAA CAGCACGTACCGTGTGGTCAGCGTCCTCACCGTCCTGCA CCAGGACTGGCTGAATGGCAAGGAGTACAAGTGCAAGG TCTCCAACAAAGCCCTCCCAGCCCCCATCGAGAAAACC ATCTCCAAAGCCAAAGGGCAGCCCCGAGAACCACAGGT GTGCACCCTGCCCCCATCCCGGGATGAGCTGACCAAGA ACCAGGTCAGCCTCTCGTGCAGTCAAAGGCTTCTATC CCAGCGACATCGCCGTGGAGTGGGAGAGCAATGGGCAG CCGGAGAACAACTACAAGACCACGCCTCCCGTGCTGGA CTCCGACGGCTCCTTCTTCCTCGTGAGCAAGCTCACCGT GGACAAGAGCAGGTGGCAGCAGGGGAACGTCTTCTCAT GCTCCGTGATGCATGAGGCTCTGCACAACCACTACACGC AGAAGAGCCTCTCCCTGTCTCCGGGTAAA |
| 87 | Nucleotide sequence human 4-1BB antigen Fc knob chain | CTGCAGGACCCCTGCAGCAACTGCCCTGCCGGCACCTTC TGCGACAACAACCGGAACCAGATCTGCAGCCCCTGCCC CCCCAACAGCTTCAGCTCTGCCGGCGGACAGCGGACCT GCGACATCTGCAGACAGTGCAAGGGCGTGTTCAGAACC CGGAAAGAGTGCAGCAGCACCAGCAACGCCGAGTGCGA CTGCACCCCGGCTTCCATTGTCTGGGAGCCGGCTGCAG CATGTGCGAGCAGGACTGCAAGCAGGGCAGGAACTGA CCAAGAAGGGCTGCAAGGACTGCTGCTTCGGCACCTTC AACGACCAGAAGCGGGGCATCTGCCGGCCCTGGACCAA CTGTAGCCTGGACGGCAAGAGCGTGCTGGTCAACGGCA CCAAAGAACGGGACGTCGTGTGCGGCCCCAGCCCTGCT GATCTGTCTCCTGGGGCCAGCAGCGTGACCCCTCCTGCC CCTGCCAGAGAGCCTGGCCACTCTCCTCAGGTCGACGAA CAGTTATATTTTCAGGGCGGCTCACCCAAATCTGCAGAC AAAACTCACACATGCCCACCGTGCCCAGCACCTGAACTC CTGGGGGGACCGTCAGTCTTCCTCTTCCCCCCAAAACCC AAGGACACCCTCATGATCTCCCGGACCCCTGAGGTCACA TGCGTGGTGGTGGACGTGAGCCACGAAGACCCTGAGGT CAAGTTCAACTGGTACGTGGACGGCGTGGAGGTGCATA ATGCCAAGACAAAGCCGCGGGAGGAGCAGTACAACAGC ACGTACCGTGTGGTCAGCGTCCTCACCGTCCTGCACCAG GACTGGCTGAATGGCAAGGAGTACAAGTGCAAGGTCTC CAACAAAGCCCTCCCAGCCCCCATCGAGAAAACCATCT CCAAAGCCAAAGGGCAGCCCCGAGAACCACAGGTGTAC ACCCTGCCCCCATGCCGGGATGAGCTGACCAAGAACCA GGTCAGCCTGTGGTGCCTGGTCAAAGGCTTCTATCCCAG CGACATCGCCGTGGAGTGGGAGAGCAATGGGCAGCCGG AGAACAACTACAAGACCACGCCTCCCGTGCTGGACTCC GACGGCTCCTTCTTCCTCTACAGCAAGCTCACCGTGGAC AAGAGCAGGTGGCAGCAGGGGAACGTCTTCTCATGCTC CGTGATGCATGAGGCTCTGCACAACCACTACACGCAGA AGAGCCTCTCCCTGTCTCCGGGTAAATCCGGAGGCCTGA ACGACATCTTCGAGGCCCAGAAGATTGAATGGCACGAG |
| 88 | Nucleotide sequence cynomolgus 4-1BB antigen Fc knob chain | TTGCAGGATCTGTGTAGTAACTGCCCAGCTGGTACATTC TGTGATAATAACAGGAGTCAGATTTGCAGTCCCTGTCCT CCAAATAGTTTCTCCAGCGCAGGTGGACAAAGGACCTGT GACATATGCAGGCAGTGTAAAGGTGTTTTCAAGACCAG GAAGGAGTGTTCCTCCACCAGCAATGCAGAGTGTGACT GCATTTCAGGGTATCACTGCCTGGGGGCAGAGTGCAGC ATGTGTGAACAGGATTGTAAACAAGGTCAAGAATTGAC AAAAAAAGGTTGTAAAGACTGTTGCTTTGGGACATTTAA TGACCAGAAACGTGGCATCTGTCGCCCCTGGACAAACT GTTCTTTGGATGGAAAGTCTGTGCTTGTGAATGGGACGA AGGAGAGGGACGTGGTCTGCGGACCATCTCCAGCCGAC CTCTCTCCAGGAGCATCCTCTGCGACCCCGCCTGCCCCT GCGAGAGAGCCAGGACACTCTCCGCAGGTCGACGAACA GTTATATTTTCAGGGCGGCTCACCCAAATCTGCAGACAA AACTCACACATGCCCACCGTGCCCAGCACCTGAACTCCT GGGGGGACCGTCAGTCTTCCTCTTCCCCCCAAAACCCAA GGACACCCTCATGATCTCCCGGACCCCTGAGGTCACATG CGTGGTGGTGGACGTGAGCCACGAAGACCCTGAGGTCA AGTTCAACTGGTACGTGGACGGCGTGGAGGTGCATAAT GCCAAGACAAAGCCGCGGGAGGAGCAGTACAACAGCA CGTACCGTGTGGTCAGCGTCCTCACCGTCCTGCACCAGG ACTGGCTGAATGGCAAGGAGTACAAGTGCAAGGTCTCC AACAAAGCCCTCCCAGCCCCCATCGAGAAAACCATCTC CAAAGCCAAAGGGCAGCCCCGAGAACCACAGGTGTACA CCCTGCCCCCATGCCGGGATGAGCTGACCAAGAACCAG GTCAGCCTGTGGTGCCTGGTCAAAGGCTTCTATCCCAGC |

TABLE 32-continued cDNA and Amino acid sequences of monomeric antigen
Fc(kih) fusion molecules

| SEQ ID NO: | Antigen | Sequence |
|---|---|---|
| | | GACATCGCCGTGGAGTGGGAGAGCAATGGGCAGCCGGA
GAACAACTACAAGACCACGCCTCCCGTGCTGGACTCCG
ACGGCTCCTTCTTCCTCTACAGCAAGCTCACCGTGGACA
AGAGCAGGTGGCAGCAGGGGAACGTCTTCTCATGCTCC
GTGATGCATGAGGCTCTGCACAACCACTACACGCAGAA
GAGCCTCTCCCTGTCTCCGGGTAAATCCGGAGGCCTGAA
CGACATCTTCGAGGCCCAGAAGATTGAATGGCACGAG |
| 89 | murine 4-1BB antigen Fc knob chain | GTGCAGAACAGCTGCGACAACTGCCAGCCCGGCACCTT
CTGCCGGAAGTACAACCCCGTGTGCAAGAGCTGCCCCC
CCAGCACCTTCAGCAGCATCGGCGGCCAGCCCAACTGC
AACATCTGCAGAGTGTGCGCCGGCTACTTCCGGTTCAAG
AAGTTCTGCAGCAGCACCCACAACGCCGAGTGCGAGTG
CATCGAGGGCTTCCACTGCCTGGCCCCCAGTGCACCAG
ATGCGAGAAGGACTGCAGACCCGGCCAGGAACTGACCA
AGCAGGGCTGTAAGACCTGCAGCCTGGGCACCTTCAAC
GACCAGAACGGGACCGGCGTGTGCCGGCCTTGGACCAA
TTGCAGCCTGGACGGGAGAAGCGTGCTGAAAACCGGCA
CCACCGAGAAGGACGTCGTGTGCGGCCCTCCCGTGGTGT
CCTTCAGCCCTAGCACCACCATCAGCGTGACCCCTGAAG
GCGGCCCTGGCGGACACTCTCTGCAGGTCCTGGTCGACG
AACAGTTATATTTTCAGGGCGGCTCACCCAAATCTGCAG
ACAAAACTCACACATGCCCACCGTGCCCAGCACCTGAA
CTCCTGGGGGGACCGTCAGTCTTCCTCTTCCCCCCAAAA
CCCAAGGACACCCTCATGATCTCCCGGACCCCTGAGGTC
ACATGCGTGGTGGTGGACGTGAGCCACGAAGACCCTGA
GGTCAAGTTCAACTGGTACGTGGACGGCGTGGAGGTGC
ATAATGCCAAGACAAAGCCGCGGGAGGAGCAGTACAAC
AGCACGTACCGTGTGGTCAGCGTCCTCACCGTCCTGCAC
CAGGACTGGCTGAATGGCAAGGAGTACAAGTGCAAGGT
CTCCAACAAAGCCCTCCCAGCCCCCATCGAGAAAACCA
TCTCCAAAGCCAAAGGGCAGCCCCGAGAACCACAGGTG
TACACCCTGCCCCCATGCCGGGATGAGCTGACCAAGAA
CCAGGTCAGCCTGTGGTGCCTGGTCAAAGGCTTCTATCC
CAGCGACATCGCCGTGGAGTGGGAGAGCAATGGGCAGC
CGGAGAACAACTACAAGACCACGCCTCCCGTGCTGGAC
TCCGACGGCTCCTTCTTCCTCTACAGCAAGCTCACCGTG
GACAAGAGCAGGTGGCAGCAGGGGAACGTCTTCTCATG
CTCCGTGATGCATGAGGCTCTGCACAACCACTACACGCA
GAAGAGCCTCTCCCTGTCTCCGGGTAAATCCGGAGGCCT
GAACGACATCTTCGAGGCCCAGAAGATTGAATGGCACG
AG |
| 90 | Fc hole chain | DKTHTCPPCPAPELLGGPSVFLFPPKPKDTLMISRTPEVTCV
VVDVSHEDPEVKFNWYVDGVEVHNAKTKPREEQYNSTYR
VVSVLTVLHQDWLNGKEYKCKVSNKALPAPIEKTISKAKG
QPREPQVCTLPPSRDELTKNQVSLSCAVKGFYPSDIAVEWE
SNGQPENNYKTTPPVLDSDGSFFLVSKLTVDKSRWQQGNV
FSCSVMHEALHNHYTQKSLSLSPGK |
| 91 | human 4-1BB antigen Fc knob chain | LQDPCSNCPAGTFCDNNRNQICSPCPPNSFSSAGGQRTCDI
CRQCKGVFRTRKECSSTSNAECDCTPGFHCLGAGCSMCEQ
DCKQGQELTKKGCKDCCFGTFNDQKRGICRPWTNCSLDG
KSVLVNGTKERDVVCGPSPADLSPGASSVTPPAPAREPGHS
PQVDEQLYFQGGSPKSADKTHTCPPCPAPELLGGPSVFLFP
PKPKDTLMISRTPEVTCVVVDVSHEDPEVKFNWYVDGVE
VHNAKTKPREEQYNSTYRVVSVLTVLHQDWLNGKEYKCK
VSNKALPAPIEKTISKAKGQPREPQVYTLPPCRDELTKNQV
SLWCLVKGFYPSDIAVEWESNGQPENNYKTTPPVLDSDGS
FFLYSKLTVDKSRWQQGNVFSCSVMHEALHNHYTQKSLS
LSPGKSGGLNDIFEAQKIEWHE |
| 92 | cynomolgus 4-1BB antigen Fc knob chain | LQDLCSNCPAGTFCDNNRSQICSPCPPNSFSSAGGQRTCDIC
RQCKGVFKTRKECSSTSNAECDCISGYHCLGAECSMCEQD
CKQGQELTKKGCKDCCFGTFNDQKRGICRPWTNCSLDGK
SVLVNGTKERDVVCGPSPADLSPGASSATPPAPAREPGHSP
QVDEQLYFQGGSPKSADKTHTCPPCPAPELLGGPSVFLFPP
KPKDTLMISRTPEVTCVVVDVSHEDPEVKFNWYVDGVEV
HNAKTKPREEQYNSTYRVVSVLTVLHQDWLNGKEYKCKV
SNKALPAPIEKTISKAKGQPREPQVYTLPPCRDELTKNQVS
LWCLVKGFYPSDIAVEWESNGQPENNYKTTPPVLDSDGSF
FLYSKLTVDKSRWQQGNVFSCSVMHEALHNHYTQKSLSL
SPGKSGGLNDIFEAQKIEWHE |

TABLE 32-continued cDNA and Amino acid sequences of monomeric antigen
Fc(kih) fusion molecules

| SEQ ID NO: | Antigen | Sequence |
|---|---|---|
| 93 | murine 4-1BB antigen Fc knob chain | VQNSCDNCQPGTFCRKYNPVCKSCPPSTFSSIGGQPNCNIC RVCAGYFRFKKFCSSTHNAECECIEGFHCLGPQCTRCEKDC RPGQELTKQGCKTCSLGTFNDQNGTGVCRPWTNCSLDGR SVLKTGTTEKDVVCGPPVVSFSPSTTISVTPEGGPGGHSLQ VLVDEQLYFQGGSPKSADKTHTCPPCPAPELLGGPSVFLFP PKPKDTLMISRTPEVTCVVVDVSHEDPEVKFNWYVDGVE VHNAKTKPREEQYNSTYRVVSVLTVLHQDWLNGKEYKCK VSNKALPAPIEKTISKAKGQPREPQVYTLPPCRDELTKNQV SLWCLVKGFYPSDIAVEWESNGQPENNYKTTPPVLDSDGS FFLYSKLTVDKSRWQQGNVFSCSVMHEALHNHYTQKSLS LSPGKSGGLNDIFEAQKIEWHE |

All 4-1BB-Fc-fusion molecule encoding sequences were cloned into a plasmid vector, which drives expression of the insert from an MPSV promoter and contains a synthetic polyA signal sequence located at the 3' end of the CDS. In addition, the vector contains an EBV OriP sequence for episomal maintenance of the plasmid.

For preparation of the biotinylated monomeric antigen/Fc fusion molecules, exponentially growing suspension HEK293 EBNA cells were co-transfected with three vectors encoding the two components of fusion protein (knob and hole chains) as well as BirA, an enzyme necessary for the biotinylation reaction. The corresponding vectors were used at a 2:1:0.05 ratio ("antigen ECD-AcTEV-Fc knob":"Fc hole":"BirA").

For protein production in 500 ml shake flasks, 400 million HEK293 EBNA cells were seeded 24 hours before transfection. For transfection cells were centrifuged for 5 minutes at 210 g, and the supernatant was replaced by pre-warmed CD CHO medium. Expression vectors were resuspended in 20 mL of CD CHO medium containing 200 µg of vector DNA. After addition of 540 µL of polyethylenimine (PEI), the solution was vortexed for 15 seconds and incubated for 10 minutes at room temperature. Afterwards, cells were mixed with the DNA/PEI solution, transferred to a 500 mL shake flask and incubated for 3 hours at 37° C. in an incubator with a 5% CO₂ atmosphere. After the incubation, 160 mL of F17 medium was added and cells were cultured for 24 hours. The production medium was supplemented with 5 µM kifunensine. One day after transfection, 1 mM valproic acid and 7% Feed 1 with supplements were added to the culture. After 7 days of culturing, the cell supernatant was collected by spinning down cells for 15 min at 210 g. The solution was sterile filtered (0.22 µm filter), supplemented with sodium azide to a final concentration of 0.01% (w/v), and kept at 4° C.

Secreted proteins were purified from cell culture supernatants by affinity chromatography using Protein A, followed by size exclusion chromatography. For affinity chromatography, the supernatant was loaded on a HITRAP® ProteinA HP column (CV=5 mL, GE Healthcare) equilibrated with 40 mL 20 mM sodium phosphate, 20 mM sodium citrate pH 7.5. Unbound protein was removed by washing with at least 10 column volumes of 20 mM sodium phosphate, 20 mM sodium citrate, 0.5 M sodium chloride containing buffer (pH 7.5). The bound protein was eluted using a linear pH-gradient of sodium chloride (from 0 to 500 mM) created over 20 column volumes of 20 mM sodium citrate, 0.01% (v/v) TWEEN® 20 (polysorbate 20), pH 3.0. The column was then washed with 10 column volumes of 20 mM sodium citrate, 500 mM sodium chloride, 0.01% (v/v) TWEEN® 20 (polysorbate 20), pH 3.0.

The pH of collected fractions was adjusted by adding 1/40 (v/v) of 2M Tris, pH8.0. The protein was concentrated and filtered prior to loading on a HILOAD® Superdex 200 column (GE Healthcare) equilibrated with 2 mM MOPS, 150 mM sodium chloride, 0.02% (w/v) sodium azide solution of pH 7.4.

For affinity determination to the human receptor, the ectodomain of human 4-1BB was also subcloned in frame with an avi (GLNDIFEAQKIEWHE) and a hexahistidine tag.

Protein production was performed as described above for the Fc-fusion protein. Secreted proteins were purified from cell culture supernatants by chelating chromatography, followed by size exclusion chromatography. The first chromatographic step was performed on a Ni-NTA SUPERFLOW™ Cartridge (5 ml, Qiagen) equilibrated in 20 mM sodium phosphate, 500 nM sodium chloride, pH7.4. Elution was performed by applying a gradient over 12 column volume from 5% to 45% of elution buffer (20 mM sodium phosphate, 500 nM sodium chloride, 500 mM Imidazole, pH7.4). The protein was concentrated and filtered prior to loading on a HILOAD® Superdex 75 column (GE Healthcare) equilibrated with 2 mM MOPS, 150 mM sodium chloride, 0.02% (w/v) sodium azide solution of pH 7.4 (Table 33).

TABLE 33

Sequences of monomeric human 4-1BB His molecule

| SEQ ID NO: | antigen | Sequence |
|---|---|---|
| 94 | nucleotide sequence human 4-1BB His | CTGCAGGACCCCTGCAGCAACTGCCCTGCCGGCACCTTCTG CGACAACAACCGGAACCAGATCTGCAGCCCCTGCCCCCCC AACAGCTTCAGCTCTGCCGGCGGACAGCGGACCTGCGACA TCTGCAGACAGTGCAAGGGCGTGTTCAGAACCCGGAAAGA |

TABLE 33-continued

Sequences of monomeric human 4-1BB His molecule

| SEQ ID NO: | antigen | Sequence |
|---|---|---|
|  |  | GTGCAGCAGCACCAGCAACGCCGAGTGCGACTGCACCCCC<br>GGCTTCCATTGTCTGGGAGCCGGCTGCAGCATGTGCGAGC<br>AGGACTGCAAGCAGGGCCAGGAACTGACCAAGAAGGGCT<br>GCAAGGACTGCTGCTTCGGCACCTTCAACGACCAGAAGCG<br>GGGCATCTGCCGGCCCTGGACCAACTGTAGCCTGGACGGC<br>AAGAGCGTGCTGGTCAACGGCACCAAAGAACGGGACGTCG<br>TGTGCGGCCCCAGCCCTGCTGATCTGTCTCCTGGGGCCAGC<br>AGCGTGACCCCTCCTGCCCCTGCCAGAGAGCCTGGCCACTC<br>TCCTCAGGTCGACGAACAGTTATATTTTCAGGGCGGCTCAG<br>GCCTGAACGACATCTTCGAGGCCCAGAAGATCGAGTGGCA<br>CGAGGCTCGAGCTCACCACCATCACCATCAC |
| 95 | human<br>4-1BB His | LQDPCSNCPAGTFCDNNRNQICSPCPPNSFSSAGGQRTCDICR<br>QCKGVFRTRKECSSTSNAECDCTPGFHCLGAGCSMCEQDCK<br>GQQELTKKGCKDCCFGTFNDQKRGICRPWTNCSLDGKSVLV<br>NGTKERDVVCGPSPADLSPGASSVTPPAPAREPGHSPQVDEQL<br>YFQGGSGLNDIFEAQKIEWHEARAHHHHHH |

Example 4

Biochemical Characterization of FAP-Targeted 4-1BB Ligand Trimer-Containing Fc Fusion Antigen Binding Molecule by Surface Plasmon Resonance The binding of FAP-targeted 4-1BB ligand trimer-containing Fc (kih) fusion antigen binding molecules to recombinant 4-1BB was assessed by surface plasmon resonance (SPR). All SPR experiments were performed on a BIACORE® instrument T100 at 25° C. with HBS-EP as a running buffer (0.01 M HEPES pH 7.4, 0.15 M NaCl, 3 mM EDTA, 0.005% Surfactant P20, Biacore, Freiburg/Germany).

The avidity of the interaction between the FAP-targeted or untargeted 4-1BB ligand trimer-containing Fc (kih) fusion antigen binding molecules and recombinant 4-1BB (human, cyno and murine) was determined as described below. The data demonstrated that both targeted 4-1BB ligand trimer-containing Fc (kih) fusion antigen binding molecules as well as untargeted DP47 4-1BB ligand trimer-containing Fc (kih) fusion antigen binding molecules bind with comparable avidities to human and cynomolgus 4-1BB but negligibly to the mouse homolog.

Recombinant biotinylated human, cynomolgus and murine 4-1BB Fc(kih) fusion molecules were directly coupled on a SA chip using the standard coupling instruction (Biacore, Freiburg/Germany). The immobilization level was about 30 RU. FAP-targeted 4-1BB ligand trimer-containing Fc (kih) fusion antigen binding molecules, or the DP47 untargeted controls, were passed at a concentration range from 0.39 to 200 nM with a flow of 30 μL/minutes through the flow cells over 120 seconds. The dissociation was monitored for 180 seconds. Bulk refractive index differences were corrected for by subtracting the response obtained on a reference empty flow cell.

For affinity measurement, direct coupling of around 7200 resonance units (RU) of an anti-human Fc specific antibody was performed on a CM5 chip at pH 5.0 using the standard amine coupling kit (GE Healthcare). FAP-targeted or untargeted 4-1BB ligand trimer-containing Fc (kih) fusion antigen binding molecules, at 50 nM were captured with a flow rate of 30 μl/min for 60 sec on flow cell 2. A dilution series (1.95 to 1000 nM) of human 4-1BB-avi-His was passed on both flow cells at 30 μl/min for 180 sec to record the association phase. The dissociation phase was monitored for 180 s and triggered by switching from the sample solution to HBS-EP. The chip surface was regenerated after every cycle using a double injection of 60 sec 10 mM Glycine-HCl pH 2.1. Bulk refractive index differences were corrected for by subtracting the response obtained on reference flow cell 1. For the interaction between the 4-1BB ligand trimer-containing Fc (kih) fusion antigen binding molecules and hu4-1BB avi His, the affinity constants were derived from the rate constants by fitting to a 1:1 Langmuir binding curve using the Biaeval software (GE Healthcare).

TABLE 34

Fittings to 1:1 Langmuir binding and Affinity constants

| Ligand | Analyte | ka (1/Ms) | kd (1/s) | KD (M) |
|---|---|---|---|---|
| FAP split 4-1BBL trimer (Construct 1.1) | hu4-1BB | 4.8E+04 | 2.6E−02 | 5.5E−07 |
| DP47 split 4-1BBL trimer (Control A) | hu4-1BB | 6.2E+04 | 3.3E−02 | 5.2E−07 |

Example 5

Functional Characterization of the Targeted 4-1BB Ligand Trimer-Containing Fc Fusion Antigen Binding Molecules 5.1. Binding on Naïve Versus Activated Human PMBCs of the FAP-Targeted 4-1BB Ligand Trimer-Containing Fc (kih) Fusion Antigen Binding Molecules Buffy coats were obtained from the Zurich blood donation center. To isolate fresh peripheral blood mononuclear cells (PBMCs) the buffy coat was diluted with the same volume of DPBS (Gibco by Life Technologies, Cat. No. 14190 326). 50 mL polypropylene centrifuge tubes (TPP, Cat.-No. 91050) were supplied with 15 mL HISTOPAQUE® reagent 1077 (SIGMA Life Science, Cat.-No. 10771, polysucrose and sodium diatrizoate, adjusted to a density of 1.077 g/mL) and the diluted buffy coat solution was layered above the HISTOPAQUE® reagent 1077. The tubes were centrifuged for 30 min at 400×g. PBMCs were then collected from the interface, washed three times with DPBS and resuspended in T cell medium consisting of RPMI 1640 medium (Gibco by Life Technology, Cat. No. 42401-042) supplied with 10% Fetal Bovine Serum (FBS, Gibco by Life Technology, Cat. No. 16000-044, Lot 941273, gamma-irradiated, mycoplasma-free and heat inactivated at 56° C. for 35 min), 1% (v/v) GlutaMAX-I (GIBCO by Life Technologies, Cat. No. 35050 038), 1 mM Sodium Pyruvate (SIGMA, Cat. No. S8636), 1% (v/v) MEM non-essential amino acids (SIGMA, Cat.-No. M7145) and 50 µM β-Mercaptoethanol (SIGMA, M3148).

PBMCs were used directly after isolation or stimulated to induce 4-1BB expression at the cell surface of T and NK cells by culturing for 4 days in T cell medium supplemented with 200 U/mL Proleukin (Novartis Pharma Schweiz AG, CHCLB-P-476-700-10340) and 2 µg/mL PHA-L (SIGMA Cat.-No. L2769) in a 6-well tissue culture plate and then 1 day in a 6-well tissue culture plate coated with 10 ug/mL anti-human CD3 (clone OKT3, BioLegend, Cat.-No. 317315) and 2 µg/mL anti-human CD28 (clone CD28.2, BioLegend, Cat.-No.: 302928) in T cell medium at 37° C. and 5% $CO_2$.

To determine binding of 4-1BBL trimer-containing Fc fusion antigen binding molecules to human PBMCs, 0.1× $10^6$ naïve or activated PBMCs were added to each well of a round-bottom suspension cell 96-well plates (Greiner bioone, cellstar, Cat. No. 650185). Plates were centrifuged 4 minutes with 400×g and at 4° C. Supernatant was discarded. Afterwards cells were stained in 100 µL/well DPBS containing 1:1000 diluted LIVE/DEAD® Fixable Blue Dead Cell Stain Kit, for UV excitation (Life Technologies, Molecular Probes, L-23105) or Fixable Viability Dye eF660 (eBioscience 65-0864-18) or LIVE/DEAD® Fixable Green Dead Cell Stain Kit (Life Technologies, Molecular Probes, L-23101) for 30 minutes at 4° C. in the dark. If DAPI was used as Live/Death stain, this staining step was skipped. Cells were washed once with 200 µL cold FACS buffer (DPBS supplied with 2% (v/v) FBS, 5 mM EDTA pH8 (Amresco, Cat. No. E177) and 7.5 mM sodium azide (Sigma-Aldrich S2002).

Next, 50 µL/well of 4° C. cold FACS buffer containing different titrated concentrations of 4-1BBL trimer-containing Fc fusion antigen binding molecules were added and cells were incubated for 120 minutes at 4° C., washed four times with 200 µL/well 4° C. FACS buffer and resuspended. Cells were further stained with 50 µL/well of 4° C. cold FACS buffer containing 0.67m/mL anti-human CD3-PerCP-Cy5.5 (clone UCHT1, mouse IgG1κ, BioLegend, Cat.-No. 300430) or 0.16 µL anti-human CD3-PE/Cy7 (clone SP34-2, mouse IgG1 κ, BD Pharmingen, Cat.-No. 557749, Lot 33324597), 0.67 µg/mL anti-human CD45-AF488 (clone HI30, mouse IgG1κ BioLegend, Cat.-No. 304017) or 0.12m/mL anti-human CD56-FITC (clone NCAM16.2, mouse IgG2bκ, BD Pharmingen, Cat.-No. 345811) or 1 µL anti-human CD56-APC (clone B159, mouse IgG1 κ, BD Pharmingen, Cat.-No. 555518, Lot 3098894), 0.25 µg/mL anti-human CD4-BV421 (clone RPA-T4, mouse IgG1κ, BioLegend, Cat.-No. 300532) or 0.23 µg/mL anti-human CD4-BV421 (clone OKT4, mouse IgG2bκ, BioLegend, Cat.-No. 317434), 0.25 µL anti-human CD8a-APC (clone RPA-T8, mouse IgG1κ, BD Pharmingen, Cat.-No. 555369) or 0.67 µL anti-human CD8a-APC/Cy7 (clone RPA-T8, mouse IgG1κ, BioLegend, Cat.-No. 301016) or 0.83 ng/mL anti-human CD8a-BV711 (clone RPA-T8, mouse IgG1κ, BD Pharmingen, Cat.-No. 301044) and 5 µg/mL PE-conjugated AffiniPure anti-human IgG Fcγ-fragment-specific goat IgG F(ab')2 fragment (Jackson ImmunoResearch, Cat. No. 109 116 098 or 109 116 170). Cells were washed twice with FACS-buffer. If cells were stained with fixable viability dyes, they were fixed with 50 µL/well DPBS containing 1% formaldehyde (Sigma, HT501320-9.5L). Cells were resuspended in FACS buffer and acquired the next or the same day using a 5-laser LSR-FORTESSA® (BD Bioscience with DIVA software) or 3-laser Miltenyi Quant Analyzer 10 (Mitenyi Biotec) and Flow Jo (FlowJo X 10.0.7). If DAPI staining was used to detect dead cells, they were resuspended in 80 µL/well FACS buffer containing 0.2 µg/mL DAPI (Santa Cruz Biotec, Cat. No. Sc-3598) and acquired the same day using a 5-laser LSR-FORTESSA® (BD Bioscience with DIVA software).

As shown in FIGS. 6A-1 to 6C-2, both FAP-targeted or untargeted 4-1BB ligand trimer-containing Fc fusion antigen binding molecules did not bind to resting human CD4+ T cells and showed no detectable binding to resting CD8+ T cells and NK cells. In contrast, both constructs bound strongly to activated NK, CD8+ or CD4+ T cells, although the latter showed approximately 10 fold lower intensity of specific fluorescence as compared to the NK cells and 20 fold decreased intensity of specific fluorescence as compared to CD8+ T cells.

FIGS. 7A-1 to 7A-4 and 7B-1 to 7B-4 show the binding of Constructs 1.1 to 1.10 as prepared in Example 1 on 4-1BB-expressing activated human CD3+ CD8+ T cells and 4-1BB-expressing activated human CD3+ CD4+ T cells, respectively. Table 35 shows the $EC_{50}$ values as measured for Constructs 1.1 to 1.10.

TABLE 35

Binding on activated human CD3+ CD8+ T cells and CD3+ CD4+ T cells

| Construct | $EC_{50}$ [nM] 4-1BB$^+$CD8$^+$ | $EC_{50}$ [nM] 4-1BB$^+$CD4$^+$ |
|---|---|---|
| Control B | 0.11 | 16.21 |
| 1.1 | 0.43 | 4.99 |
| 1.2 | 0.18 | 20.79 |
| 1.3 | 0.07 | 2.82 |
| 1.4 | 0.19 | 0.34 |
| 1.5 | 0.17 | 2.67 |
| 1.6 | 0.19 | 0.95 |
| 1.7 | 0.26 | 16.47 |
| 1.8 | 0.14 | 2.77 |
| 1.9 | 0.18 | 12.92 |
| 1.10 | 0.12 | 0.3 |

FIGS. 8A-1 to 8A-4 and 8B-1 to 8B-4 show the binding of Constructs 2.1, 2.3, 2.4, 2.5 and 2.6 as prepared in Example 2 on CD4+ and CD8+ from fresh human blood and on activated 4-1BB-expressing CD4+ T cells and CD8+ T cells, respectively. Gates were set on living CD45+ CD3+ CD4+ or CD45+ CD3+ CD8+ T cells and MFI of PE-conjugated AffiniPure anti-human IgG IgG Fcγ-fragment-specific goat F(ab')2 fragment were blotted against the titrated concentration of targeted split trimeric 4-1BB ligand Fc fusion variants. Table 36 shows the $EC_{50}$ values as measured for Constructs 2.1, 2.3, 2.4, 2.5 and 2.6.

TABLE 36

Binding on activated 4-1BB-expressing CD4+ T cells and CD8 + T cells

| Construct | $EC_{50}$ [nM] 4-1BB$^+$CD8$^+$ | $EC_{50}$ [nM] 4-1BB$^+$CD4$^+$ |
|---|---|---|
| Control B | 0.36 | 0.42 |
| Control C | 0.39 | 0.41 |
| Control E | 0.57 | 0.76 |
| 2.1 | 0.21 | 0.24 |

TABLE 36-continued

Binding on activated 4-1BB-expressing CD4+ T cells and CD8 + T cells

| Construct | EC$_{50}$ [nM]<br>4-1BB$^+$CD8$^+$ | EC$_{50}$ [nM]<br>4-1BB$^+$CD4$^+$ |
|---|---|---|
| 2.3 | 0.44 | 0.3 |
| 2.4 | 0.3 | 0.38 |
| 2.5 | 0.35 | 0.68 |
| 2.6 | 0.33 | 0.24 |

5.2 Binding of FAP-Targeted 4-1BB Ligand Trimer-Containing Fc Fusion Antigen Binding Molecule to Activated Mouse Splenocytes Mouse spleens were collected in 3 mL PBS and a single cell suspension was generated using gentle MACS tubes (Miltenyi Biotec Cat.-No. 130-096-334) and gentleMACS Octo Dissociator (Miltenyi Biotec). Afterwards splenocytes were filtered through a 30 µm Pre-Separation Filters (Miltenyi Biotec Cat.-No. 130-041-407) and centrifuged for 7 min at 350×g and 4° C. Supernatant was aspirated and cells were resuspended in RPMI 1640 medium supplied with 10% (v/v) FBS, 1% (v/v) GlutaMAX-I, 1 mM Sodium-Pyruvate, 1% (v/v) MEM non-essential amino acids, 50 µM β-Mercaptoethanol and 10% Penicillin-Streptomycin (SIGMA, Cat.-No. P4333). $10^6$ cells/mL were cultured for 2 days in a 6-well tissue culture plate coated with 10 µg/mL anti-mouse CD3ε Armenian Hamster IgG (clone 145-2C11, BioLegend, Cat.-No. 100331) and 2 µg/mL anti-mouse CD28 Syrian Hamster IgG (clone 37.51, BioLegend, Cat.-No. 102102).

Activated mouse splenocytes were harvested, washed in DPBS, counted and 0.1×10$^6$ cells were transferred to each well of a 96 U-bottom non-tissue culture treated well plate. Supernatant was removed and cells were stained in 100 uL/well DPBS containing 1:5000 diluted Fixable Viability Dye eF660 (Bioscience, Cat-No. 65-0864-18) for 30 min at 4° C. Cells were washed with PBS and stained in 50 uL FACS buffer containing different concentration of FAP-targeted 4-1BB ligand trimer-containing Fc fusion antigen binding molecules (FAP split 4-1BBL trimer), untargeted 4-1BB ligand trimer-containing Fc fusion antigen binding molecules (DP47 split 4-1BBL trimer) or anti-mouse CD137 human IgG1 P329G LALA mAb (clone Lob.12.3, BioXcell Catalog#: BE0169). Cells were incubated for 120 min at 4° C. Cells were washed four times with FACS buffer and stained in 50 FACS buffer containing 10 µg/mL purified anti-mouse CD16/CD32 rat IgG-Fc-Block (BD Pharmingen, Cat.-No. 553142 clone 2.4G2), 5 µg/mL anti-mouse CD8b rat IgG2bκ-FITC (BioLegend, Cat.-No. 126606, clone YTS156.7.7), 0.67 µg/mL anti-mouse CD3 rat IgG2bκ-APC-Cy7 (BioLegend, Cat.-No. 100222, clone 17A2), 0.67 µg/mL anti-mouse CD4 rat IgG2bκ-PE-Cy7 (BioLegend, Cat.-No. 100422, clone GK1.5), 2 µg/mL anti-mouse NK1.1 Mouse (C3H×BALB/c) IgG2aκ-PerCp-Cy5.5 (BioLegend, Cat.-No. 108728, clone PK136) and 10 µg/mL PE-conjugated AffiniPure polyclonal F(ab')2 Fragment goat anti-human IgG, Fcγ fragment specific, minimal cross-reactive to bovine mouse and rabbit serum proteins (Jackson ImmunoResearch, Cat.-No. 109-116-170) for 30 min at 4° C. Cells were washed twice with 200 µL/well cold FACS buffer. Cells were fixed with 50 DPBS containing 1% formaldehyde. Cells were resuspended in FACS-buffer and acquired the next day using a 5-laser LSR-FORTESSA® (BD Bioscience with DIVA software).

Figure 9A:
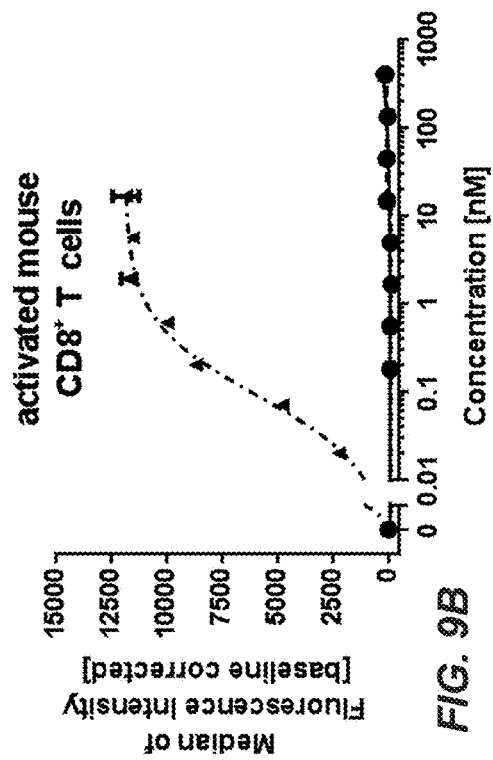
FIGS. 9A and 9B show the binding of FAP-targeted 4-1BB ligand trimer-containing Fc(kih) fusion antigen binding molecules (FAP split 4-1BBL trimer, filled circles) or DP47 untargeted 4-1BB ligand trimer-containing Fc(kih) fusion antigen binding molecules (DP47 split 4-1BBL trimer; open circles) to activated mouse splenocytes. In particular, the binding to activated mouse CD4+ T cells is shown in FIG. 9A and to activated mouse CD8+ T cells in FIG. 9B. An anti-mouse CD137-specific human IgG1 P329G LALA antibody (clone Lob12.3) was used as positive control (Triangles). The binding is characterized by plotting the MFI of R-PE-labeled anti-human IgG Fcγ-specific goat IgG F(ab') 2 fragment that is used as secondary detection antibody versus the concentration in nM of the tested split 4-1BBL trimer constructs. MFI was measured by flow cytometry and baseline corrected by subtracting the MFI of the blank control.
Figure 9B:
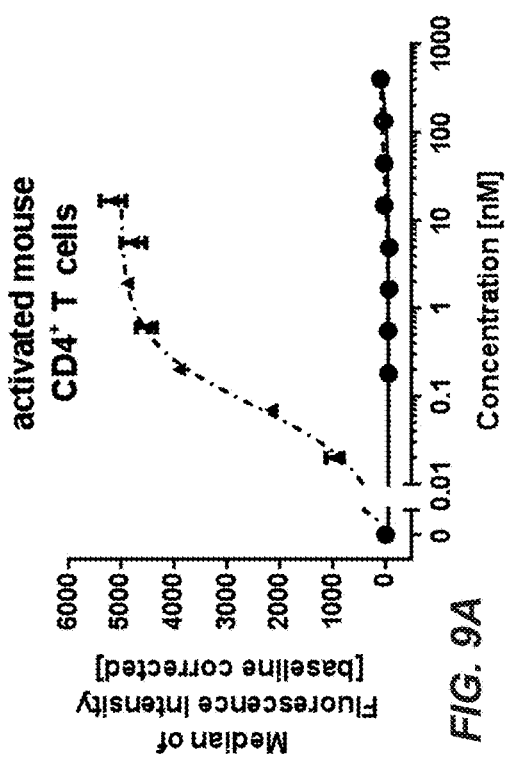

As shown in FIGS. 9A and 9B, FAP-targeted hu4-1BB ligand trimer-containing Fc fusion antigen binding molecules (FAP split hu4-1BBL trimer) and untargeted hu4-1BB ligand trimer-containing Fc fusion antigen binding molecules (DP47 split hu4-1BBL trimer) do not bind to mouse 4-1BB. Therefore activity cannot be tested in immune competent mice. For in vivo mode of action studies either humanized mouse models in immune incompetent mice or surrogates containing mouse 4-1BBL trimers as shown in FIGS. 3A to 3C have to be used.

5.3 Binding to FAP-Expressing Tumor Cells

For binding assays on FAP expressing cells, the human melanoma cell line MV-3 (see Ruiter et al., Int. J. Cancer 1991, 48(1), 85-91), WM-266-4 (ATTC CRL-1676) or NIH/3T3-huFAP clone 39 cell line were used. To generate the latter cell line, NIH/3T3 cells were transfected with human FAP (NIH/3T3-huFAP clone 39). The cells were generated by transfection of mouse embryonic fibroblast NIH/3T3 cells (ATCC CRL-1658) with the expression pETR4921 plasmid encoding human FAP under a CMV promoter. Cells were maintained in the presence of 1.5 µg/mL puromycin (InvivoGen, Cat.-No.: ant-pr-5). 0.1×10$^6$ of FAP expressing tumor cells were added to each well of a round-bottom suspension cell 96-well plates (Greiner bio-one, cellstar, Cat.-No. 650185). Cells were washed once with 200 µL DPBS and pellets were resuspended. 100 µL/well of 4° C. cold DPBS buffer containing 1:5000 diluted Fixable Viability Dye EFLUOR® 450 (eBioscience, Cat.-No. 65-0863-18) or Fixable Viability Dye EFLUOR® 660 (eBioscience, Cat.-No. 65-0864-18) were added and plates were incubated for 30 minutes at 4° C. Cells were washed once with 200 µL 4° C. cold DPBS buffer and resuspended in 50 µL/well of 4° C. cold FACS buffer (DPBS supplied with 2% (v/v) FBS, 5 mM EDTA pH 8 (Amresco, Cat.-No. E177) and 7.5 mM Sodium azide (Sigma-Aldrich 52002) containing different concentrations of titrated 4-1BBL trimer-containing Fc fusion antigen binding molecules, followed by incubation for 1 hour at 4° C. After washing four times with with 200 µL/well, cells were stained with 50 µL/well of 4° C. cold FACS buffer containing 30 µg/mL FITC-conjugated AffiniPure anti-human IgG Fcγ-fragment-specific goat F(ab')$_2$ fragment (Jackson ImmunoResearch, Cat.-No. 109-096-098) or 5 µg/mL PE-conjugated AffiniPure anti-human IgG Fgγ-fragment-specific goat F(ab')2 fragment (Jackson ImmunoResearch, Cat. No. 109-116-098 or 109-116-170) for 30 minutes at 4° C. Cells were washed twice with 200 µL 4° C. FACS buffer and then resuspended in 50 µL/well DPBS containing 1% formaldehyde. The same or the next day cells were resuspended in 100 µL FACS-buffer and acquired using 5-laser LSR-FORTESSA® (BD Bioscience with DIVA software) or 3-laser Miltenyi Quant Analyzer 10 (Mitenyi Biotec) and Flow Jo (FlowJo X 10.0.7).

Figure 10A:
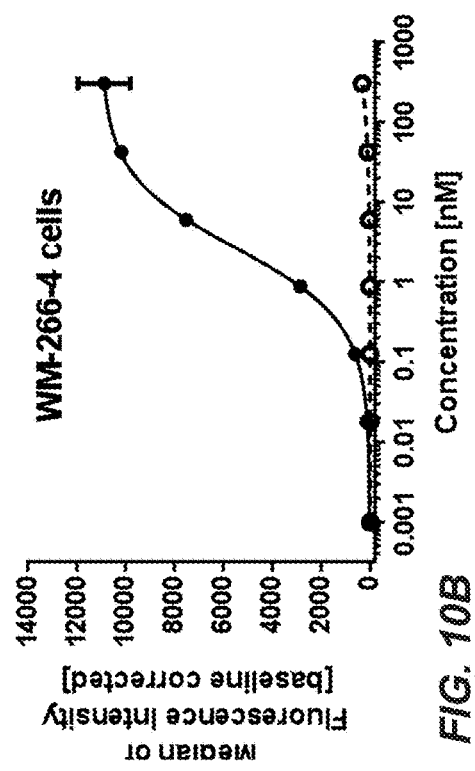
FIGS. 10A and 10B show the binding of 4-1BB ligand trimer-containing Fc(kih) fusion antigen binding molecules (filled circles: FAP-targeted 4-1BB ligand trimer-containing Fc(kih) fusion antigen binding molecule Construct 1.1, open circles: DP47 untargeted 4-1BB ligand trimer-containing Fc(kih) fusion antigen binding molecule Control A to fibroblast activation protein (FAP)-expressing human melanoma (FIG. 10A) MV-3 cell line and (FIG. 10B) WM-266-4 cell line. The binding is characterized by plotting the MFI of R-PE-labeled anti-human IgG Fcγ-specific goat IgG F(ab')2 fragment that is used as secondary detection antibody versus the concentration in nM of tested split 4-1BBL trimer constructs. MFI was measured by flow cytometry and baseline corrected by subtracting the MFI of the blank control.
Figure 10B:
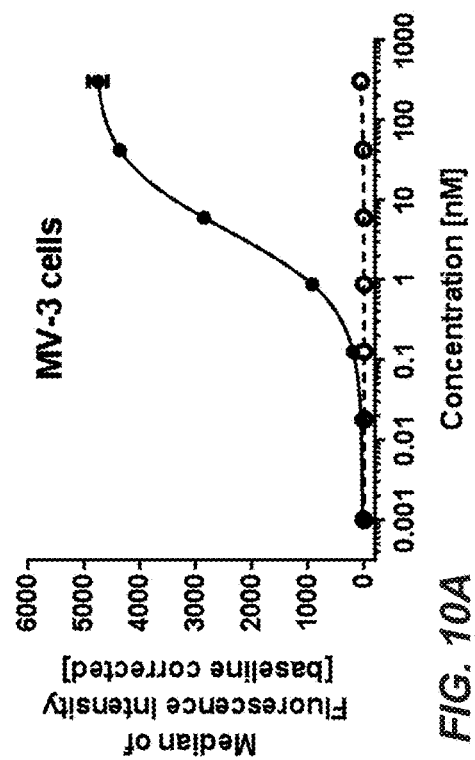

As shown in FIGS. 10A and 10B, the FAP-targeted 4-1BB ligand trimer-containing Fc(kih) fusion antigen binding molecule (FAP split 4-1BBL trimer) Construct 1.1, but not the untargeted, DP47-Fab-containing construct (DP47 split 4-1BBL trimer) Control A, efficiently bound to human fibroblast activation protein (FAP)-expressing melanoma (10A) MV-3 cells or (10B) WM-266-4 cells.

Figures 4, 7B:
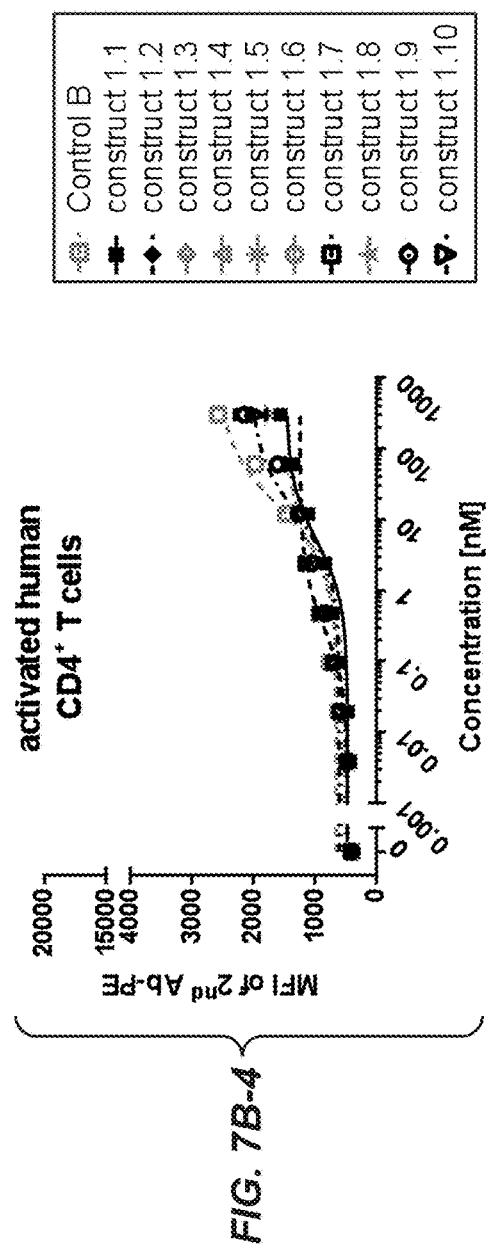
Figures 1, 11A:
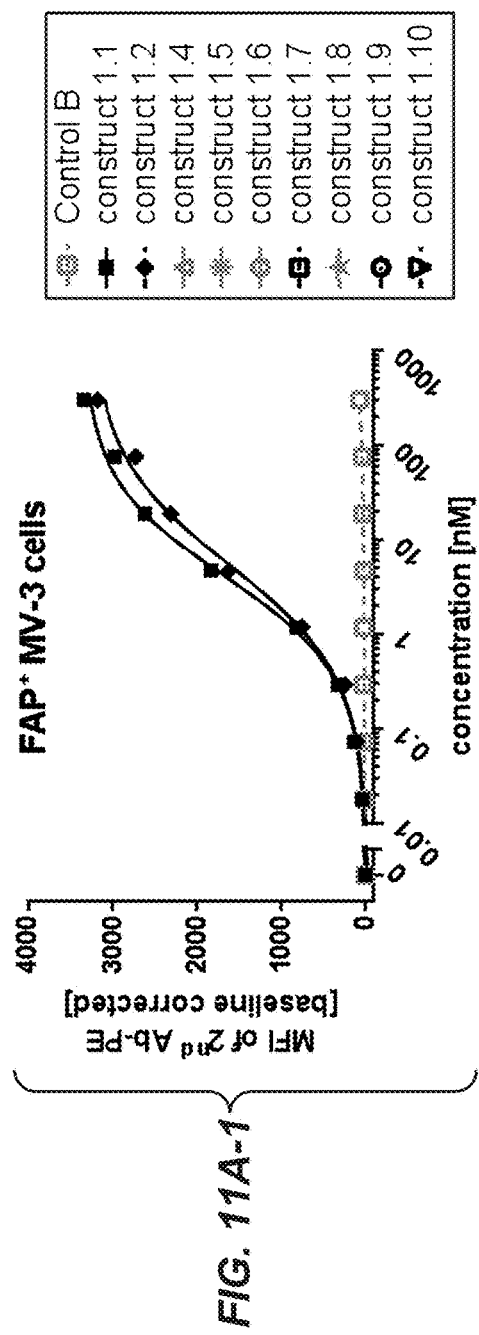
Figures 2, 11A:
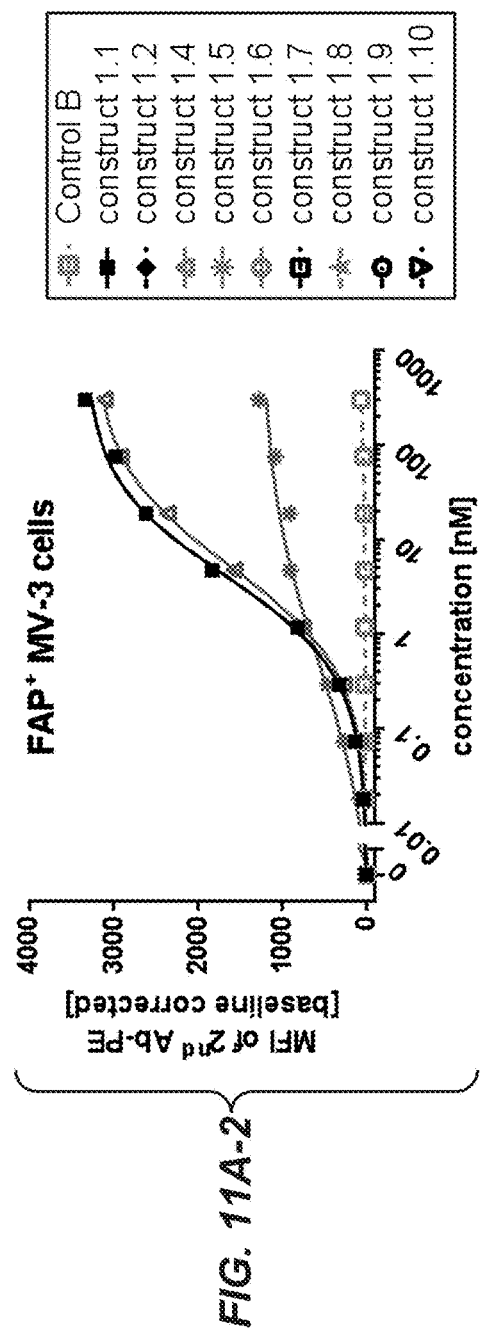
Figures 1, 11B:
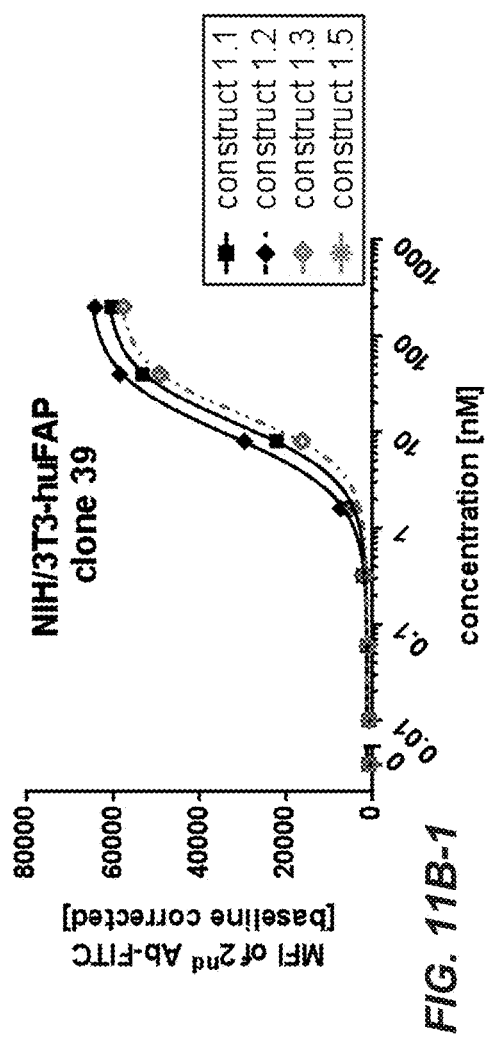
Figures 2, 11B:
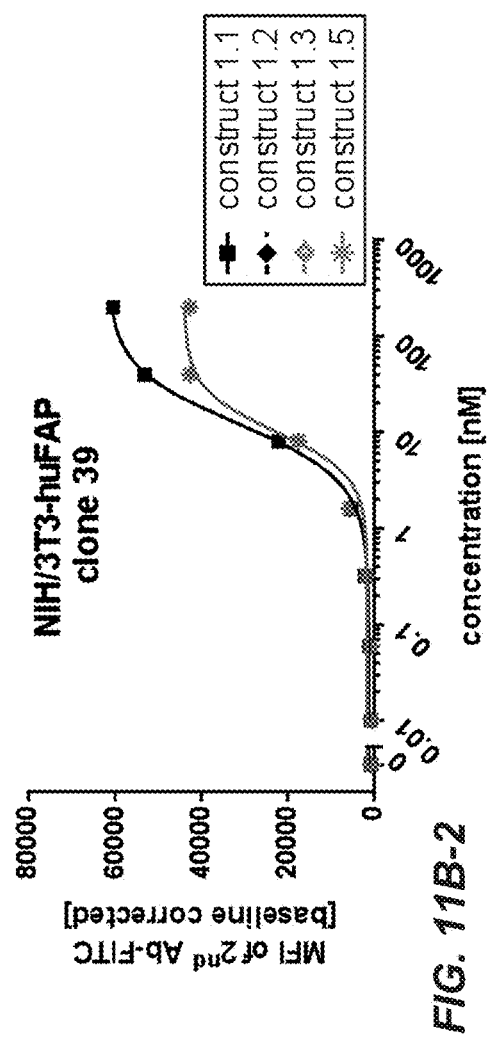
Figure 1:
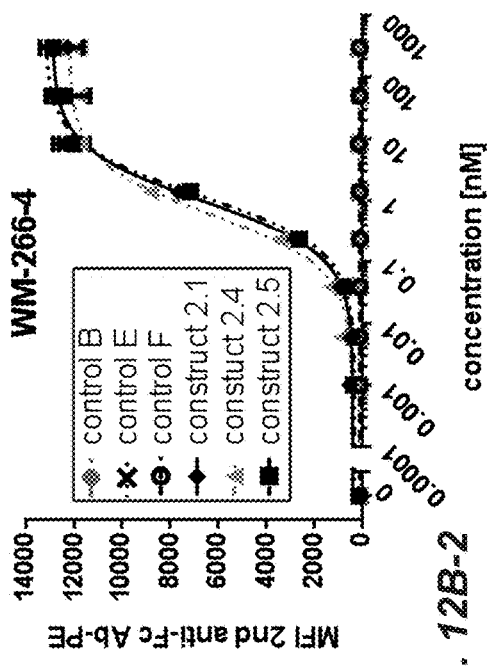
Figure 2:
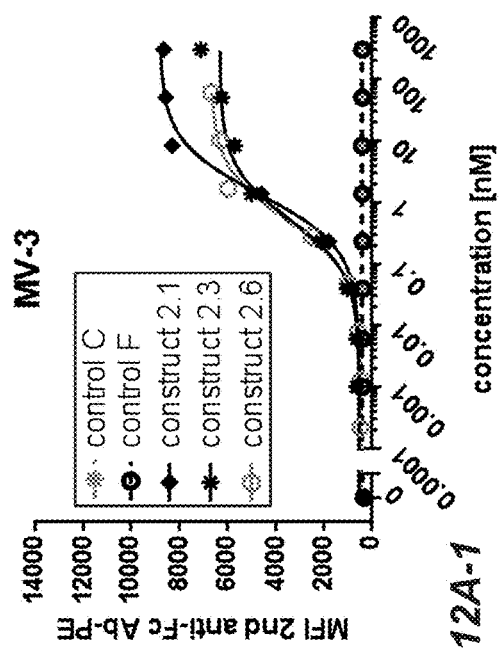

FIGS. 11A-1 to 11A-4 shows the binding of Constructs 1.1 to 1.10 as prepared in Example 1 to human-FAP expressing human melanoma MV-3 cells and in FIGS. 11B-1 and 11B-2 the binding of Construct 1.1, 1.2, 1.3 and 1.5 to human FAP expressing NIH/3T3-huFAP clone 39 transfected mouse embryonic fibroblast cells is presented. Table 37 shows the EC$_{50}$ values as measured for Constructs 1.1 to 1.10.

TABLE 37

Binding to human FAP-expressing tumor cells

| Construct | EC$_{50}$ [nM] FAP$^+$ MV-3 | EC$_{50}$ [nM] NIH/3T3-hu FAP |
|---|---|---|
| 1.1 | 4.14 | 12.2 |
| 1.2 | 5.36 | 9.35 |
| 1.3 | — | 14.97 |
| 1.4 | 5.13 | — |
| 1.5 | 0.53 | 10.06 |
| 1.6 | 8.16 | — |
| 1.7 | 4.09 | — |
| 1.8 | 2.79 | — |
| 1.9 | 4.22 | — |
| 1.10 | 4.31 | — |

Figure 12A:
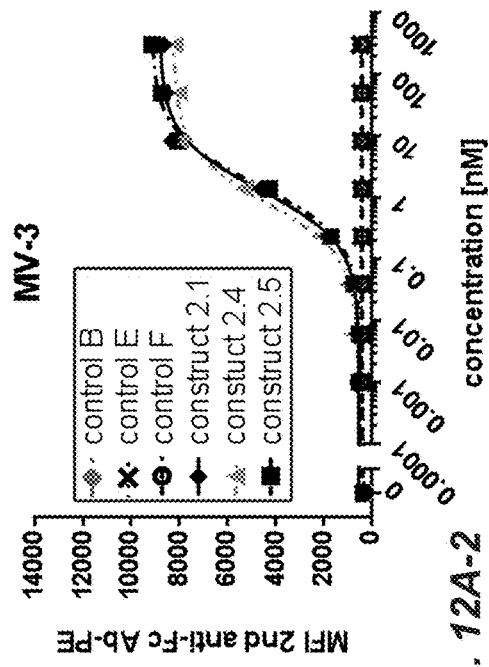
Figure 12B:
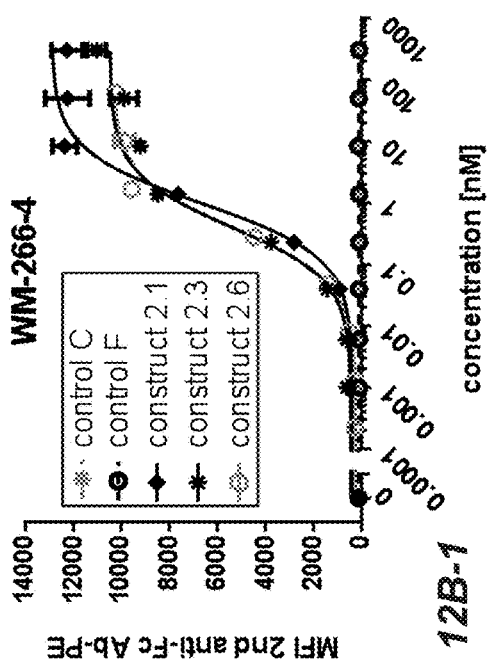
Figures 2, 13A:
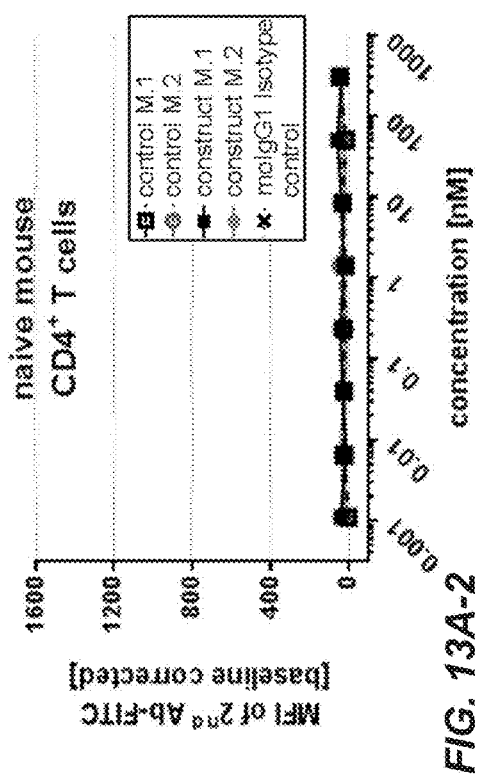
Figures 2, 13B:
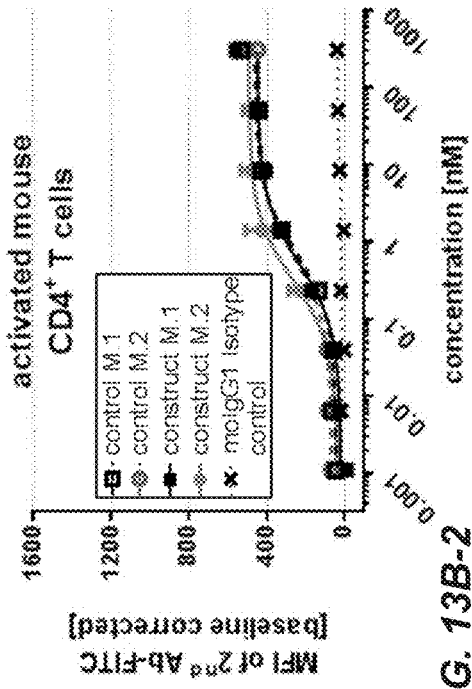
Figures 1, 13A:
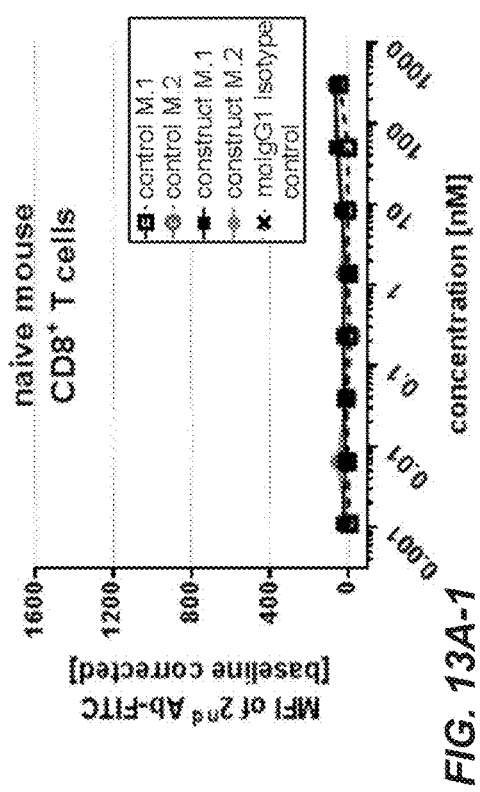
Figures 1, 13B:
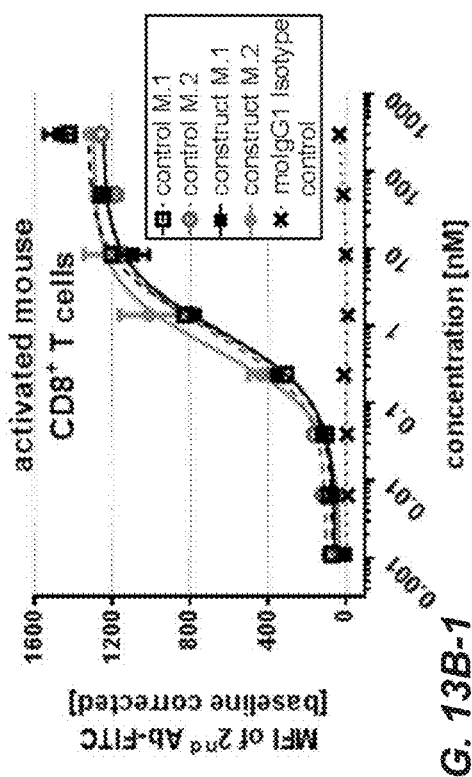

FIGS. 12A-1 to 12B-2 shows the binding of different FAP (4B9)-targeted or untargeted split trimeric human 4-1BB ligand Fc (kih) constructs to human-FAP expressing human melanoma MV-3 cells (FIGS. 12A-1 and 12A-2) and WM-266-4 cells (FIGS. 12B-1 and 12B-2). The constructs 2.1, 2.3, 2.4, 2.5 and 2.6 were prepared as described in Example 2 and Controls were prepared as described herein before. Gates were set on living tumor cells and MFI of PE-conjugated AffiniPure anti-human IgG Fcγ-fragment-specific goat F(ab')2 fragment were blotted against the titrated concentration of targeted split trimeric 4-1BB ligand Fc fusion constructs. Table 38 shows the EC$_{50}$ values as measured.

TABLE 38

Binding to human FAP-expressing tumor cells

| Construct | EC$_{50}$ [nM] FAP$^+$ MV-3 | EC$_{50}$ [nM] FAP$^+$ WM-266-4 |
|---|---|---|
| 2.1 | 1.66 | 0.99 |
| 2.3 | 0.53 | 0.42 |
| 2.4 | 0.83 | 0.59 |
| 2.5 | 1.66 | 1.2 |

5.4 Functional Characterization of the Murine Targeted 4-1BB Ligand Trimer-Containing Fc (kih) Fusion Antigen Binding Molecules 5.4.1 Binding to Activated Mouse Splenocytes Mouse spleens were collected in 3 mL PBS and a single cell suspension was generated using gentle MACS tubes (Miltenyi Biotec Cat.-No. 130-096-334) and gentleMACS Octo Dissociator (Miltenyi Biotec). Afterwards splenocytes were filtered through 30 μm Pre-Separation Filters (Miltenyi Biotec Cat.-No. 130-041-407) and centrifuged for 7 min at 350×g and 4° C. Supernatant was aspirated and cells were resuspended in RPMI 1640 medium supplied with 10% (v/v) FBS, 1% (v/v) GlutaMAX-I, 1 mM Sodium-Pyruvate, 1% (v/v) MEM non-essential amino acids, 50 μM β-Mercaptoethanol.

For binding on fresh mouse splenocytes cells were used directly. To induce mouse 4-1BB expression on T cells, mouse splenocytes were activated as following: 10$^6$ cells/mL were cultured for 2 days in a 6-well tissue culture plate coated with 10 μg/mL anti-mouse CD3c Armenian Hamster IgG (clone 145-2C11, BioLegend, Cat.-No. 100331) and 2 μg/mL anti-mouse CD28 Syrian Hamster IgG (clone 37.51, BioLegend, Cat.-No. 102102).

Fresh mouse splenocytes or activated mouse splenocytes were collected, washed in DPBS (Gibco life technologies, Cat.-No. 14190-136), counted and 0.1×10$^6$ cells were transferred to each well of a 96 U-bottom non-tissue culture treated well plate (Greiner bio-one, cell star, Cat.-No. 650185). Supernatant was removed and cells were stained in 100 uL/well 4° C. cold DPBS containing 1:1000 diluted LIVE/DEAD® Fixable Aqua Dead Cell Stain Kit (Life Technologies, L34957) for 30 min at 4° C. Cells were washed with cold DPBS and stained in 50 uL/well cold FACS buffer (DPBS supplied with 2% (v/v) FBS, 5 mM EDTA pH8 (Amresco, Cat. No. E177) and 7.5 mM Sodium azide (Sigma-Aldrich S2002)) containing different concentration of mouse 4-1BB ligand trimer-containing Fc(kih) fusion molecules or mouse IgG1 κ Isotype control (BioLegend, Cat.-No. 400153, clone MOPC-21). Cells were incubated for 120 min at 4° C., washed four times with cold DPBS and stained in 50 μL/well cold FACS buffer containing 30 μg/mL FITC-conjugated anti-mouse IgG Fc-gamma-specific goat IgG F(ab')2 (Jackson Immunoresearch, Cat.-No. 115-096-071) for 30 min at 4° C. Afterwards cells were washed twice with cold DPBS and stained with 50 μL/well FACS buffer supplied with 10 μg/mL purified anti-mouse CD16/CD32 rat IgG-Fc-Block (BD Pharmingen, Cat.-No. 553142 clone 2.4G2), 0.67 μg/mL anti-mouse CD8a-APC-Cy7 (BioLegend, Cat.-No. 100714, clone 53-6.7), 0.67 μg/mL anti-mouse CD3c-PerCP-Cy5.5 (BioLegend, Cat.-No. 100328, clone 145-2C11), 0.67 μg/mL anti-mouse CD4 rat IgG2bκ-PE-Cy7 (BioLegend, Cat.-No. 100422, clone GK1.5) for 30 min at 4° C. Cells were washed twice with 200 μL/well cold DPBS, fixed with 50 μL/well DPBS containing 1% Formaldehyde and resuspended in FACS-buffer. Cells were acquired using 3-laser MACSQuant Analyzer 10 (Miltenyi Biotech) and Flow Jo v10.0.7 (FlowJo LLC). Gates were set on CD3$^+$ CD8$^+$ or CD3$^+$ CD4$^+$ T cells and the median florescence intensity (MFI) of FITC-conjugated anti-mouse IgG Fc-gamma-specific goat IgG F(ab')2 was analyzed and normalized by the subtraction of the MFI of the blank control (no addition of mouse 4-1BB ligand trimer-containing Fc(kih) fusion molecule). The MFI was blotted against the concentration of used mouse 4-1BB ligand trimer-containing Fc(kih) fusion molecules to display the binding to mouse 4-1BB cell-bound molecule.

As can be seen in FIGS. 13A-1 to 13B-2, the murine 4-1BBL Constructs M.1 and M.2 as well as corresponding control molecules Control M.1 and Control M.2 bind with a quite similar affinity to mouse 4-1BB. Table 39 shows the EC$_{50}$ values as measured for Constructs M.1 and M.2 and the control molecules.

TABLE 39

Binding on activated 4-1BB-expressing CD4+ T cells and CD8 + T cells

| Construct | EC$_{50}$ [nM] 4-1BB$^+$CD8$^+$ | EC$_{50}$ [nM] 4-1BB$^+$CD4$^+$ |
|---|---|---|
| Control M.1 | 0.95 | 0.74 |
| M.1 | 0.87 | 0.52 |
| Control M.2 | 0.78 | 0.6 |
| M.2 | 0.54 | 0.42 |

5.4.2 Binding on FAP-Expressing Tumor Cells

For binding assays on FAP expressing cells, the human melanoma cell line MV-3 (see Ruiter et al., Int. J. Cancer 1991, 48(1), 85-91) and WM-266-4 (ATTC CRL-1676) were used (anti-FAP specific clone 28H1 is mouse/human-crossreactive). 0.1×10$^6$ of FAP expressing tumor cells were added to each well of a round-bottom suspension cell 96-well plates (Greiner bio-one, cellstar, Cat.-No. 650185). Cells were washed once with 200 μL cold DPBS and pellets were resuspended in 100 μL/well of 4° C. cold DPBS buffer containing 1:1000 diluted LIVE/DEAD® Fixable Aqua Dead Cell Stain Kit (Life Technologies, L34957) and incubated for 30 min at 4° C. Cells were washed once with 200 µL cold DPBS buffer and resuspended in 50 µL/well of cold FACS buffer (DPBS supplied with 2% (v/v) FBS, 5 mM EDTA pH8 (Amresco, Cat. No. E177) and 7.5 mM Sodium azide (Sigma-Aldrich S2002)) containing murine 4-1BB ligand trimer-containing Fc(kih) fusion molecules at a series of concentrations followed by incubation for 1 hour at 4° C. After washing four times with 200 µL DPBS/well, cells were stained with 50 µL/well of 4° C. cold FACS buffer containing 30 µg/mL FITC-conjugated anti-mouse IgG Fc-gamma-specific goat IgG F(ab')2 (Jackson Immunoresearch, Cat.-No. 115-096-071) for 30 min at 4° C. Cells were washed twice with 200 µL/well cold DPBS buffer, fixed with 50 µL/well DPBS containing 1% Formaldehyde and resuspended in FACS-buffer. Cells were acquired using 3-laser MACSQuant Analyzer 10 (Miltenyi Biotech) and Flow Jo v10.0.7 (FlowJo LLC). Gates were set on living cells and the median florescence intensity (MFI) of FITC-conjugated anti-mouse IgG Fc-gamma-specific goat IgG F(ab')2 was analyzed and normalized by the subtraction of the MFI of the blank control (no addition of mouse 4-1BB ligand trimer-containing Fc(kih) fusion molecule). The MFI was blotted against the concentration of used murine 4-1BB ligand trimer-containing Fc(kih) fusion molecules to display the binding to murine 4-1BB cell-bound molecule. As expected, the murine 4-1BBL constructs M.1 and M.2 bind with a quite similar affinity to FAP whereas the control molecules do not bind.

Figure 14B:
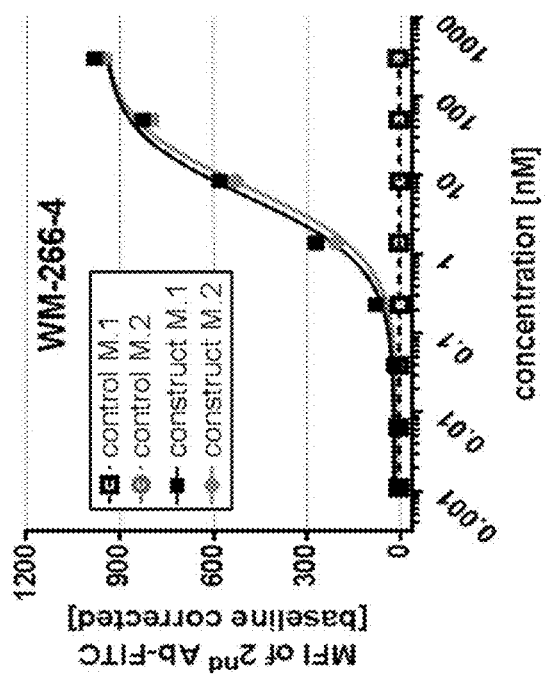
FIGS. 14A and 14B show the binding of different FAP-targeted or untargeted split trimeric mouse 4-1BB ligand Fc (kih) constructs to human FAP expressing tumor cells. Binding was detected with FITC-fluorochrome conjugated anti-mouse IgG Fcγ-specific goat IgG F(ab')2 fragment. Shown is the median of fluorescence intensity (MFI) versus the concentration of tested constructs. Binding was monitored on MV-3 cells (FIG. 14A) and WM-266-4 cells (FIG. 14B). FAP-targeted split trimeric mouse 4-1BB ligand Fc (kih) constructs M.1 and M.2 bind with a quite similar affinity to FAP.
Figure 14A:
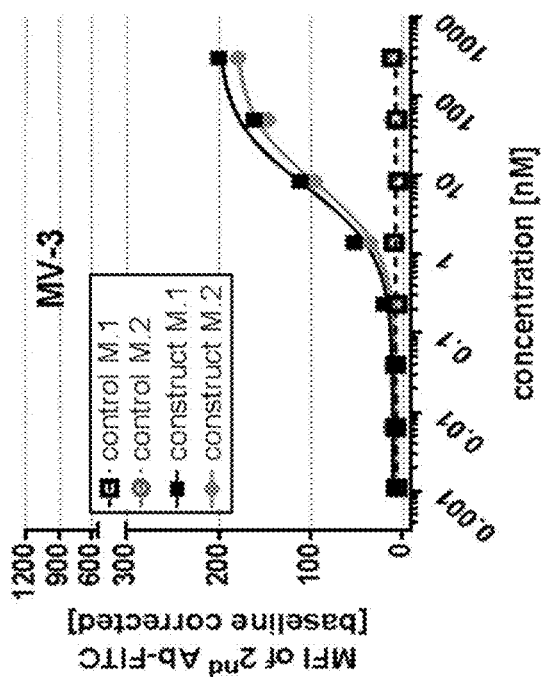

FIGS. 14 and 14B shows the binding of the FAP-targeted or untargeted split trimeric murine 4-1BB ligand Fc (kih) Constructs M.1 and M.2 to human-FAP expressing human melanoma MV-3 cells (FIG. 14A) and WM-266-4 cells (FIG. 14B). Table 40 shows the $EC_{50}$ values as measured.

TABLE 40

| Binding to human FAP-expressing tumor cells | | |
|---|---|---|
| Construct | $EC_{50}$ [nM] FAP+ MV-3 | $EC_{50}$ [nM] FAP+ WM-266-4 |
| M.1 | 7.26 | 5.14 |
| M.2 | 6.9 | 5.63 |

Example 6

Biological Activity of the Targeted 4-1BB Ligand Trimer-Containing Fc Fusion Antigen Binding Molecules 6.1. NF-κB Activation in HeLa Cells Expressing Human 4-1BB Generation of HeLa Cells Expressing Human 4-1BB and NF-κB-Luciferase The cervix carcinoma cell line HeLa (ATCC CCL-2) was transduced with a plasmid based on the expression vector pETR10829, which contains the sequence of human 4-1BB (Uniprot accession Q07011) under control of a CMV-promoter and a puromycin resistance gene. Cells were cultured in DMEM medium supplemented with 10% (v/v) FBS, 1% (v/v) GlutaMAX-I and 3 µg/mL Puromycin.

4-1BB-transduced HeLa cells were tested for 4-1BB expression by flow cytometry: $0.2 \times 10^6$ living cells were resuspended in 100 µL FACS buffer containing 0.1 µg PerCP/Cy5.5 conjugated anti-human 4-1BB mouse IgG1κ clone 4B4-1 (BioLegend Cat.-No. 309814) or its isotype control (PerCP/Cy5.5 conjugated mouse IgG1κ isotype control antibody clone MOPC-21, BioLegend Cat.-No. 400150) and incubated for 30 minutes at 4° C. Cells were washed twice with FACS buffer, resuspended in 300 µL FACS buffer containing 0.06 µg DAPI (Santa Cruz Biotec, Cat. No. Sc-3598) and acquired using a 5-laser LSR-FORTESSA® (BD Bioscience, DIVA software). Limited dilutions were performed to generate single clones as described: human-4-1BB-transduced HeLa cells were resuspended in medium to a density of 10, 5 and 2.5 cells/ml and 200 µl of cell suspensions were transferred to round bottom tissue-culture treated 96-well plates (6 plates/cell concentration, TPP Cat.-No. 92697). Single clones were harvested, expanded and tested for 4-1BB expression as described above. The clone with the highest expression of 4-1BB (clone 5) was chosen for subsequent transfection with the NF-κB-luciferase expression-vector 5495p Tranlucent HygB. The vector confers transfected cells both with resistance to Hygromycin B and capacity to express luciferase under control of NF-kB-response element (back bone vector Panomics, Cat.-No. LR0051 with introduced HyB resistance). Human-4-1BB HeLa clone 5 cells were cultured to 70% confluence. 50 µg (40 µL) linearized (restriction enzymes AseI and SalI) 5495p Tranlucent HygB expression vector were added to a sterile 0.4 cm Gene Pulser/MicroPulser Cuvette (Biorad, Cat.-No, 165-2081). $2.5 \times 10^6$ human-4-1BB HeLa clone 5 cells in 400 µl supplement-free DMEM medium were added and mixed carefully with the plasmid solution. Transfection of cells was performed using a Gene Pulser Xcell total system (Biorad, Cat-No. 165-2660) under the following settings: exponential pulse, capacitance 500 µF, voltage 160 V, resistance ∞. Immediately after the pulse transfected cells were transferred to a 75 cm² tissue culture flask (TPP, Cat.-No. 90075) with 15 mL 37° C. warm DMEM medium supplied with 10% (v/v) FBS and 1% (v/v) GlutaMAX-I. Next day, culture medium containing 3 µg/mL Puromycin and 200 µg/mL Hygromycin B (Roche, Cat.-No. 10843555001) was added. Surviving cells were expanded and limited dilution was performed as described above to generate single clones.

Clones were tested for 4-1BB expression as described above and for NF-κB-Luciferase activity as following: Clones were harvested in selection medium and counted using a Cell Counter Vi-cell xr 2.03 (Beckman Coulter, Cat.-No. 731050). Cells were set to a cell density of $0.33 \times 10^6$ cells/mL and 150 µL of this cell suspension were transferred to each well of a sterile white 96-well flat bottom tissue culture plate with lid (greiner bio-one, Cat.-No. 655083) and—as a control—to normal 96-well flat bottom tissue culture plate (TPP Cat.-No. 92096) to test survival and cell density the next day. Cells were incubated at 37° C. and 5% $CO_2$ overnight. The next day 50 µL of medium containing different concentrations of recombinant human tumor necrosis factor alpha (rhTNF-α, PeproTech, Cat.-No. 300-01A) were added to each well of a 96-well plate resulting in final concentration of rhTNF-α of 100, 50, 25, 12.5, 6.25 and 0 ng/well. Cells were incubated for 6 hours at 37° C. and 5% $CO_2$ and then washed three times with 200 µL/well DPBS. Reporter Lysis Buffer (Promega, Cat-No: E3971) was added to each well (40 µl) and the plates were stored over night at −20° C. The next day frozen cell plates and Detection Buffer (Luciferase 1000 Assay System, Promega, Cat.-No. E4550) were thawed to room temperature. 100 uL of detection buffer were added to each well and the plate was measured as fast as possible using a SpectraMax M5/M5e microplate reader and the SoftMax Pro Software (Molecular Devices). Measured units of released light for 500 ms/well (URLs) above control (no rhTNF-α added) were taken as luciferase activity. The NF-κB-luc-4-1BB-HeLa clone 26 exhibiting the highest luciferase activity and a considerable level of 4-1BB-expression and was chosen for further use.

NF-κB Activation in Hela Cells Expressing Human 4-1BB Co-Cultured with FAP-Expressing Tumor Cells NF-κB-luciferase human-4-1BB HeLa cells were harvested and resuspended in DMEM medium supplied with 10% (v/v) FBS and 1% (v/v) GlutaMAX-I to a concentration of $0.2 \times 10^6$ cells/ml. 100 µl ($2 \times 10^4$ cells) of this cell suspension were transferred to each well of a sterile white 96-well flat bottom tissue culture plate with lid (greiner bio-one, Cat. No. 655083) and the plate were incubated at 37° C. and 5% $CO_2$ overnight. The next day 50 µL of medium containing titrated concentrations of FAP-targeted 4-1BB ligand trimer-containing Fc fusion antigen binding molecules (FAP split 4-1BBL trimer) or DP47-untargeted 4-1BB ligand trimer-containing Fc fusion antigen binding molecules (DP47 split 4-1BBL trimer) were added. FAP-expressing tumor cells (MV3, WM-266-4 or NIH/3T3-huFAP clone 39) were resuspended in DMEM medium supplied with 10% (v/v) FBS and 1% (v/v) GlutaMAX-I to a concentration of $2 \times 10^6$ cells/ml.

Suspension of FAP-expressing tumor cell (50 final ratio 1:5) or only medium were added to each well and plates were incubated for 6 hours at 37° C. and 5% $CO_2$. Cells were washed two times with 200 µL/well DPBS. 40 µl freshly prepared Reporter Lysis Buffer (Promega, Cat-No: E3971) were added to each well and the plate were stored over night at −20° C. The next day frozen cell plate and Detection Buffer (Luciferase 1000 Assay System, Promega, Cat. No. E4550) were thawed at room temperature. 100 µL of detection buffer were added to each well and luciferase activity was measured as fast as possible using a SpectraMax M5/M5e microplate reader and a SoftMax Pro Software (Molecular Devices) counting light emission in URL (units of released light for 0.5s/well) or Victor3 1420 multilabel counter plate reader (Perkin Elmer) and the Perkin Elmer 2030 Manager Software counting light emission as counts per seconds (CPS) and blotted against the concentration of tested constructs.

Figures 16A, 16B, 16C:
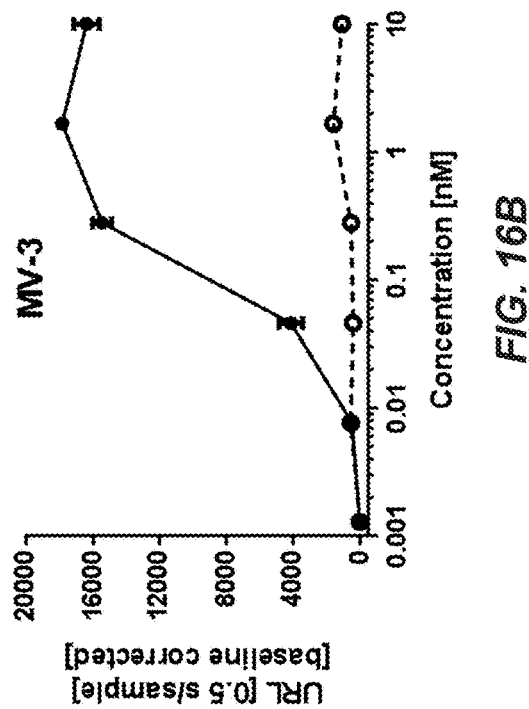
FIGS. 16A to 16C show that the activation of the NFκB signaling pathway by FAP-targeted 4-1BB ligand trimer-containing Fc(kih) fusion antigen binding molecule (Construct 1.1) is strictly dependent on its binding to FAP-expressing target cells. Human CD137 expressing NFκB reporter HeLa cells were co-cultured with the indicated tumor cells exhibiting different levels of cell surface FAP expression. Luciferase activity was assessed as described in Example 6.1 after culturing cells in the absence or presence of 4-1BBL-containing molecules at the indicated concentrations for 6 hours. Filled circles refer to Construct 1.1. Open circles refer to DP47 untargeted 4-1BB ligand trimer-containing Fc(kih) fusion antigen binding molecule (Control A). Cell line NIH/3T3-human FAP clone 39 was used as target cells in 16A; 16B shows the activation with MV3 cell line as target cells and 16C with WM-266-4 cell line as target cells. Activity is characterized by blotting the units of released light (URL) measured during 0.5 s versus the concentration in nM of tested split 4-1BBL trimer constructs. URLs are emitted due to luciferase-mediated oxidation of luciferin to oxyluciferin.
Figures 3, 17A:
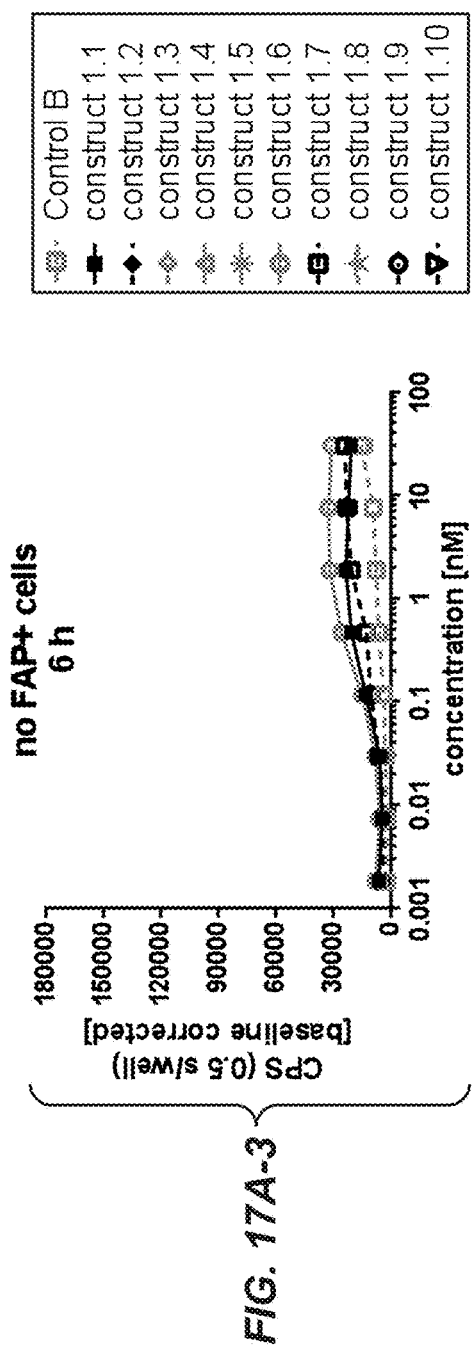
Figures 4, 17A:
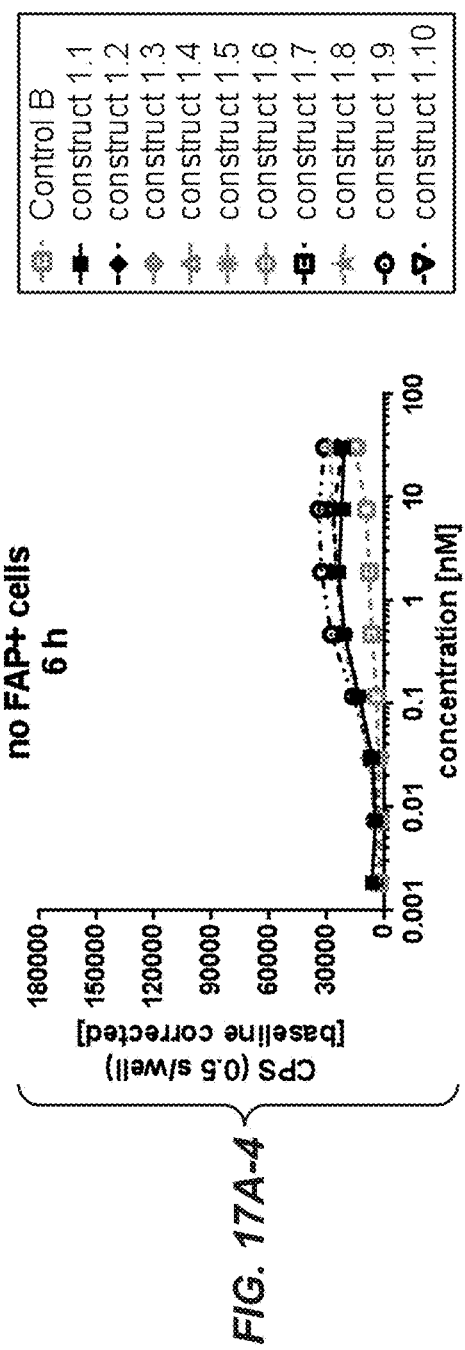
Figures 1, 17B:
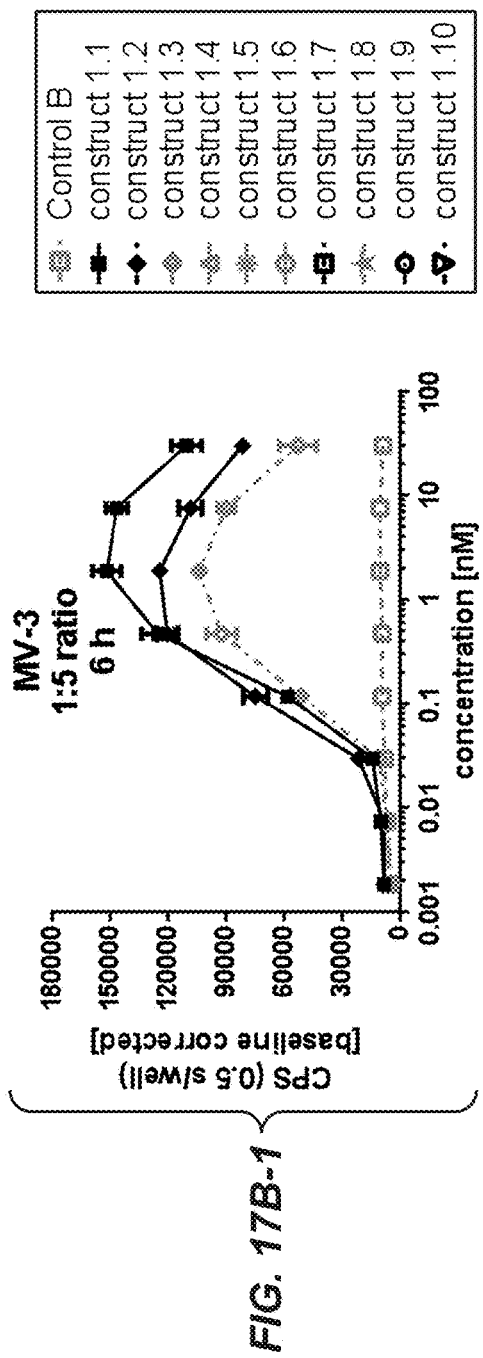
Figures 2, 17B:
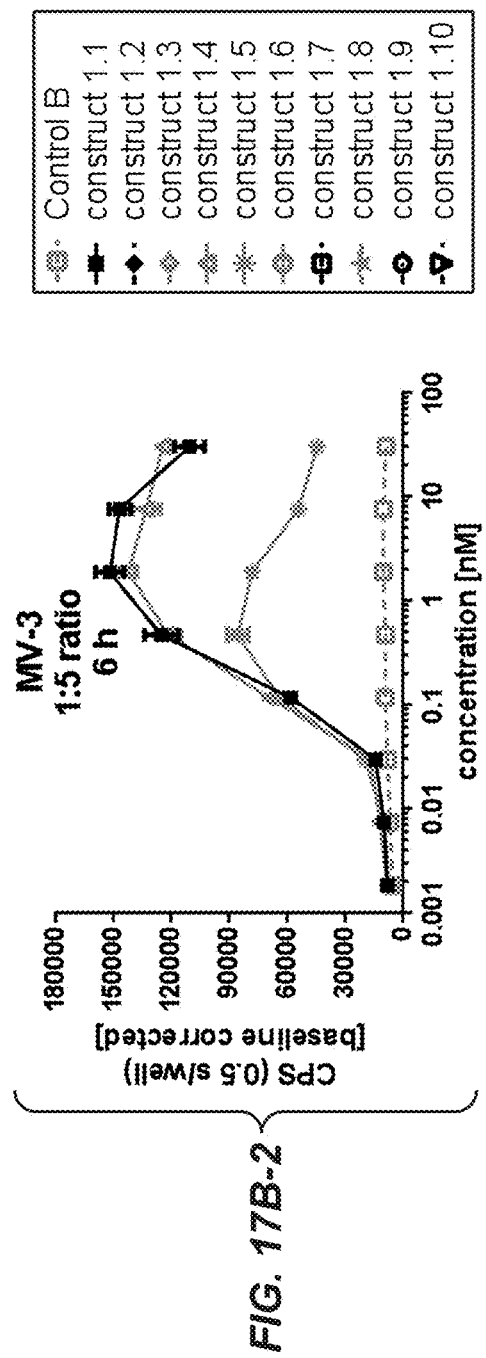
Figures 3, 17C:
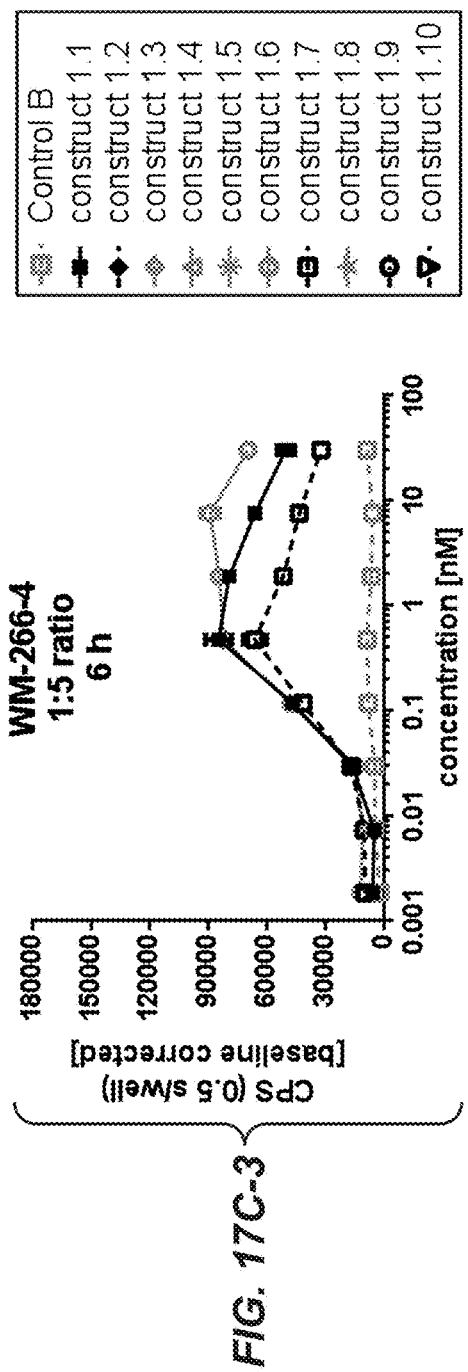
Figures 4, 17C:
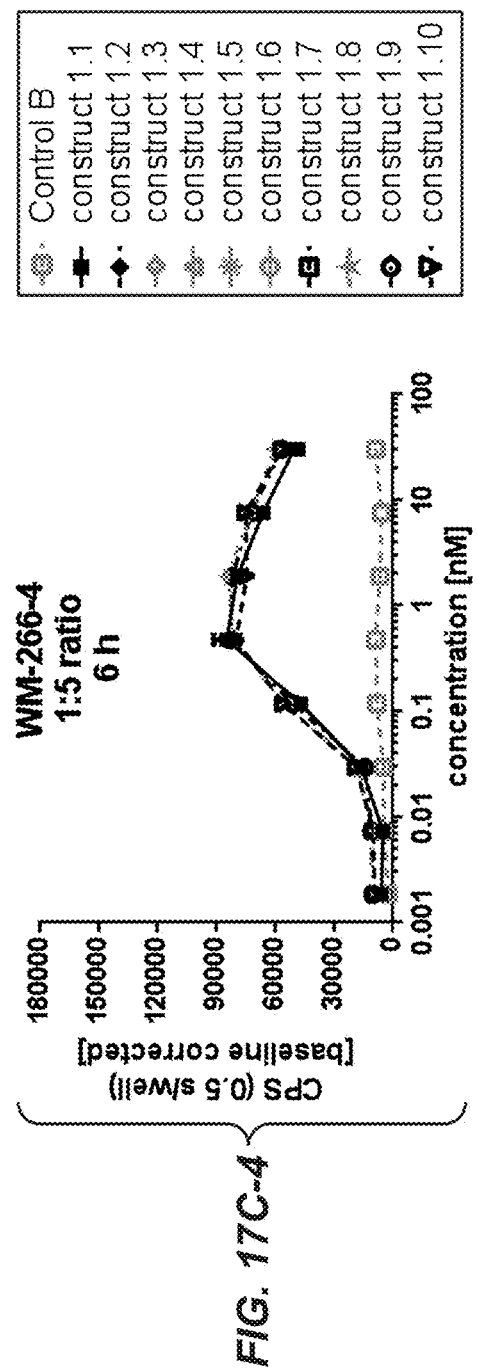
Figure 18A:
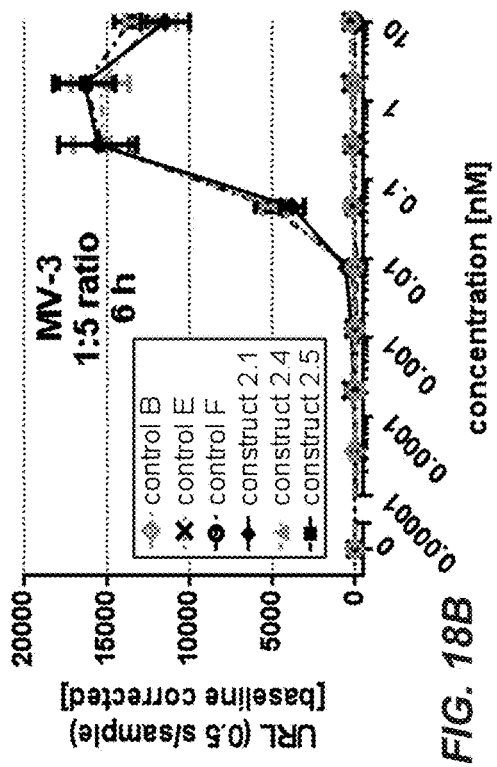
FIGS. 18A to 18F show the NFκB-activation-induced Luciferase expression and activity as measured for the constructs of Example 2. Units of released light (URL) are measured for 0.5 s/well and plotted against the used concentration of FAP-targeted or untargeted split trimeric human 4-1BB ligand Fc (kih) constructs. Human 4-1BB-expressing HeLa-reporter cells were incubated for 6 h in the absence or presence of crosslinking human-FAP expressing human melanoma cell line MV-3 or WM-266-4. URLs were measured and blotted against the concentrations of different FAP-targeted or untargeted split trimeric human 4-1BB ligand Fc (kih) constructs 2.1, 2.3, 2.4, 2.5 and 2.6 and Controls B, C, E and F. The cell ratio is one 4-1BB-expressing HeLa reporter cell to five tumor cells. For better display activation curves were split to two different display-blots with construct 2.1 (monovalent FAP-targeted split trimeric human 4-1BB ligand Fc (kih)).
Figure 18B:
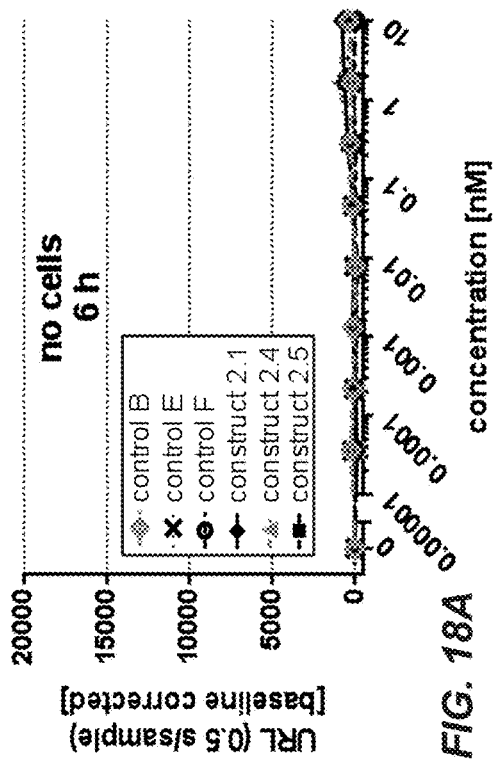
Figure 18C:
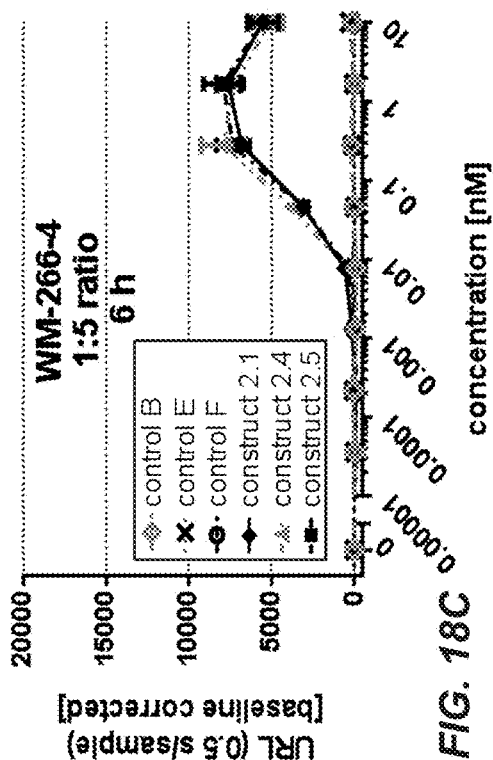
Figure 18E:
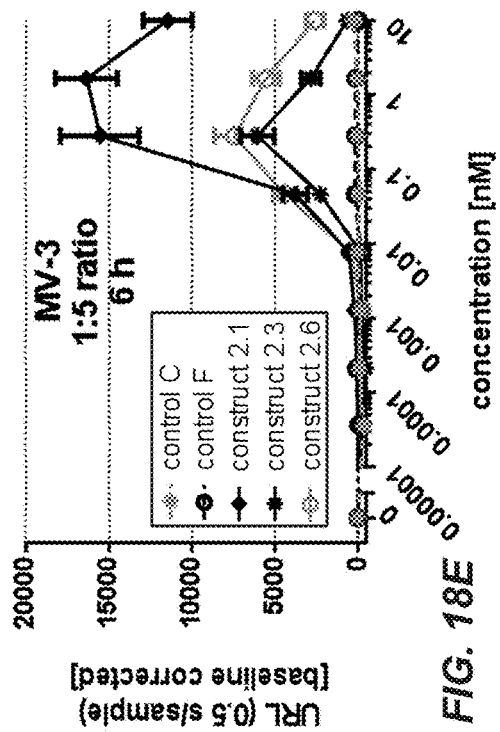
Figure 18D:
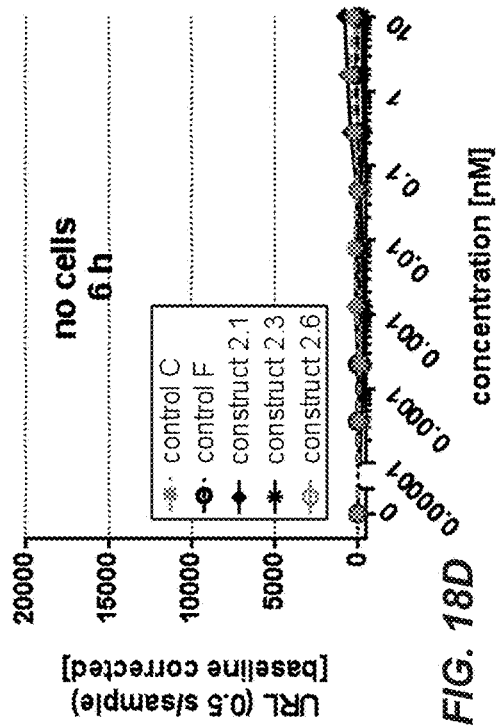
Figure 18F:
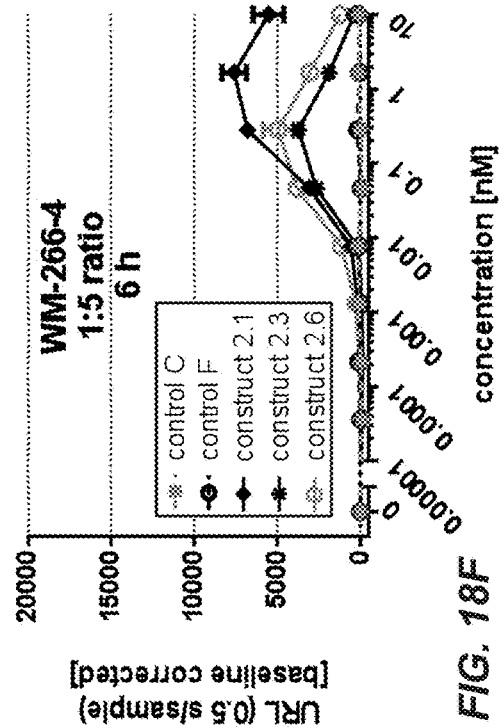
Figure 20A:
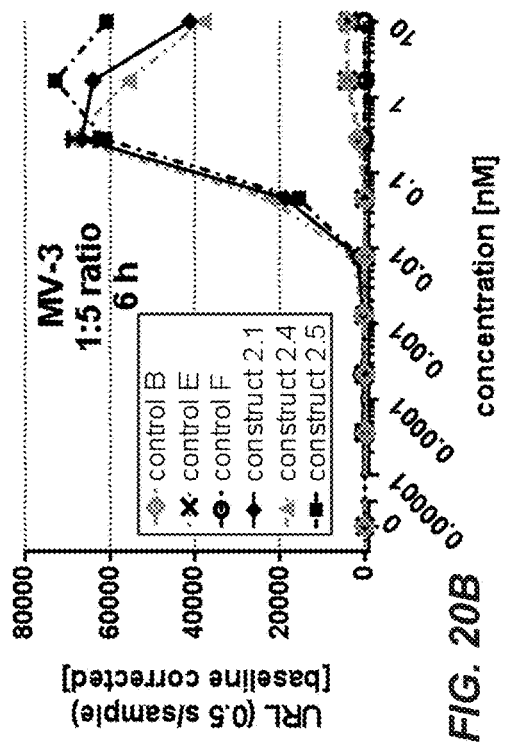
FIGS. 20A to 20F show the NFκB-activation-induced Luciferase expression and activity. Units of released light (URL) are measured for 0.5 s/well and plotted against the used concentration of FAP-targeted or untargeted split trimeric human 4-1BB ligand Fc (kih) constructs. Cynomolgus monkey 4-1BB-expressing T293-HEK-reporter cells were incubated for 6 h in the absence or presence of crosslinking human-FAP expressing human melanoma cell line MV-3 or WM-266-4. URLs were measured and blotted against the concentrations of different FAP-targeted or untargeted split trimeric human 4-1BB ligand Fc (kih) constructs. The cell ratio is one 4-1BB-expressing T293-HEK reporter cell to five MV-3 or two WM-266-4 cells. For better display activation curves were split to two different blots with Construct 2.1 as comparison curve.
Figure 20B:
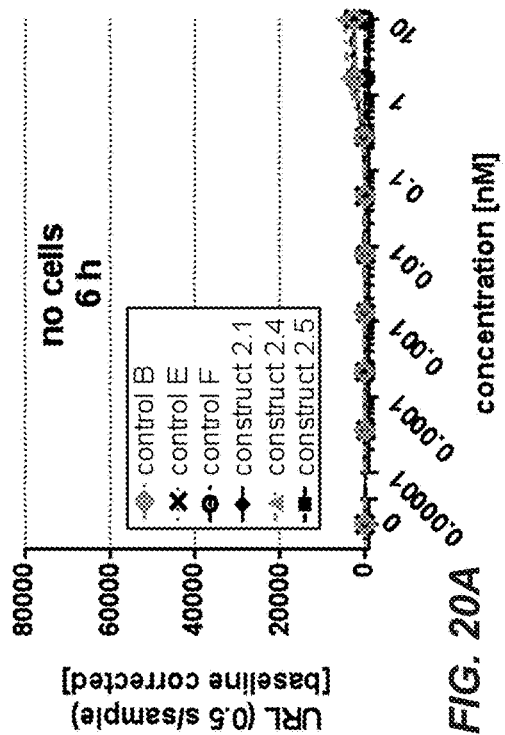
Figure 20C:
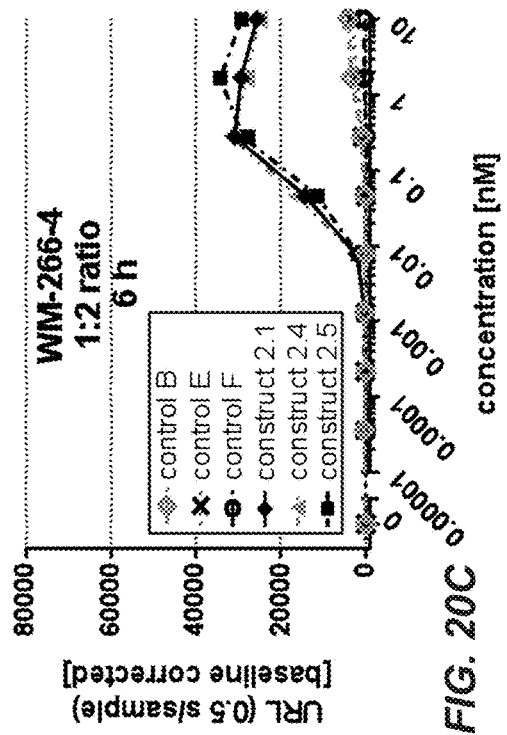
Figure 20E:
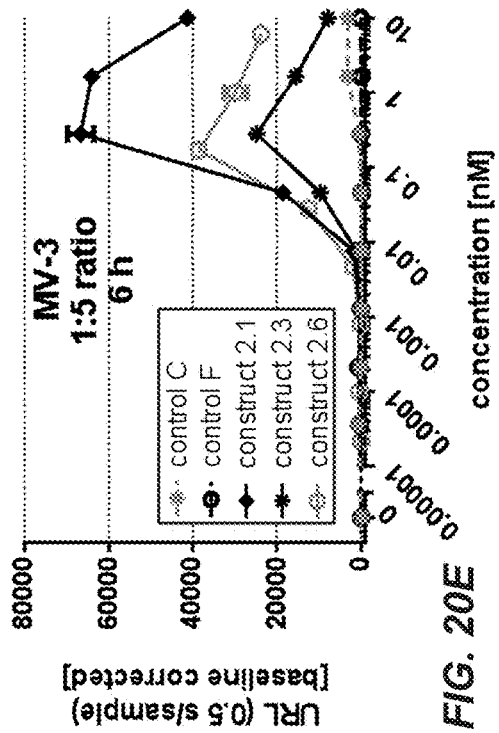
Figure 20D:
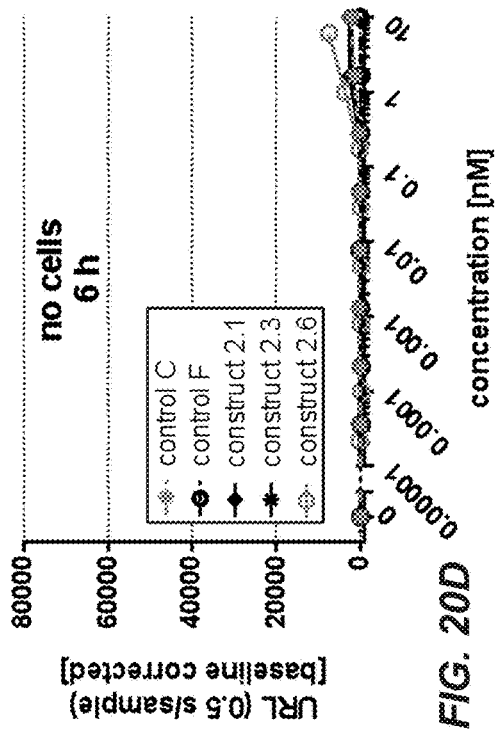
Figure 20F:
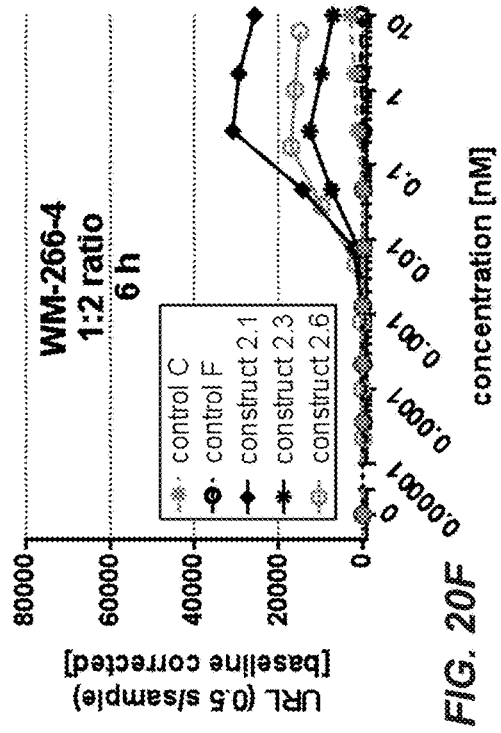

FAP-targeted 4-1BB ligand trimer-containing Fc fusion antigen binding molecule (FAP split 4-1BBL trimer) triggered activation of the NFκB signaling pathway in the reporter cell line in the presence of FAP-expressing tumor cells. In contrast, the untargeted variant of the same molecule failed to trigger such an effect at any of the tested concentrations (FIGS. 16A to 16C). This activity of targeted 4-1BBL was strictly dependent on the expression of FAP at the cell surface of tumor cells as no NF-kB activation could be detected upon culturing of the NF-kB reporter cell line with FAP-negative tumor cells even in the presence of FAP-targeted 4-1BB ligand trimer-containing Fc fusion antigen binding molecule. The activities as measured for Constructs 1.1 to 1.10 are shown in FIGS. 17A-1 to 17C-4 and the data as measured for Constructs 2.1, 2.4 and 2.5 are presented in FIGS. 18A to 18F.

6.2. NFκB Activation in HEK T293 Cells Expressing Cynomolgus Monkey 4-1BB

Generation of HEK T293 Cells Expressing Cynomolgus Monkey 4-1BB and NFκB-Luciferase For the production of viral-like particles (VLP) the Human Embryonic Kidney (HEK) T293/17 (ATCC CRL-11268) was transfected using Lipofectamine® LTX Reagent with PLUS™ Reagent (Life Technologies, Cat.-No. 15338100) with the vector pETR14372 encoding a NFκB-luciferase-IRIS-GFP reporter gene cassette (NFκB-luc-GFP) accordingly to the manufacture's protocol. 6 hours later DMEM supplied with 10% FBS medium replacement was performed and VLP were harvested 4 days later. Fresh HEK 293T cells were transduced at a confluency of 70-80% with the produced pETR14372-VLP and 4 µg/mL polybrene. Cells were cultured for 24 h and a medium exchange was performed. The transduced HEK T293/17 cells were harvested and a limited dilution of 1 cell/well was performed to screen for stable single clones. The single clones were stimulated with 25 ng/mL TNF-α (PeproTech Inc. Cat.-No. 300-01A) in the medium and were screened for a positive GFP signal over time using the Incuyte Zoom Fluorescence Microscope System (Essen Bioscience). After GFP signal recording cells were tested for luciferase activity using the NANO GLO® Luciferase Kit (Promega, N1120) accordingly to the manufacture's protocol. Luciferase activity was measured using Victor3 1420 multilabel counter plate reader (Perkin Elmer) and the Perkin Elmer 2030 Manager Software. Light emission was counted in counts per seconds (CPS) for 0.5 sec/well. The clone 61 showed the highest expression of GFP and Luciferase after TNF-α activation and was further used for the reporter cell line generation.

As described above, new VLP were produced using the vector pETR14879 encoding cynomolgus monkey 4-1BB and a puromycine resistance and the HEK 293T NFκB-fluc-GFP clone 61 cell line was transduced at a confluency of 70-80% with the produced pETR14879-VLP and 4 µg/mL polybrene. Cells were cultured for 24 h and a medium exchange was performed. Four days after transduction the cells were stained with PE-conjugated anti-human cynomolgus-crossreactive 4-1BB antibody (mouse IgG1κ, clone MOPC-21, BioLegend, Cat.-No. 309804) in DPBS containing 1% FBS, were sorted by FACS (ARIA, BD) and seeded with 5 cells/well in DMEM supplied with 10% FBS medium containing 1 µg/mL Puromycine (InvivoGen, Cat.-No. ant-pr). Growing clones were tested as described for GFP and Luciferase activity after TNF-α stimulation and for high cynomolgus monkey 4-1BB expression by flow cytometry. Double positive clones were chosen and tested for Luficerase activity in the presence of monovalent FAP-targeted Construct 2.1 or Control B and FAP-expressing MV-3 or WM-266-4 cells. HEK T293/17-NF-κB-luc-GFP-cy4-1BB expressing Clone 61-13 was chosen to be used for all further experiments.

NFκB Activation of HEK T293/17 Reporter Cells Expressing Cynomolgus Monkey 4-1BB Co-Cultured with FAP-Expressing Tumor Cells HEK T293/17-NFκB-luc-GFP-cy4-1BB expressing Clone 61-13 cells were harvested and resuspended in DMEM medium supplied with 10% (v/v) FBS and 1% (v/v) GlutaMAX-I to a concentration of $0.2 \times 10^6$ cells/mL. 100 µl ($2 \times 10^4$ cells) of this cell suspension were transferred to each well of a sterile white 96-well flat bottom tissue culture plate with lid (greiner bio-one, Cat. No. 655083) and the plate were incubated at 37° C. and 5% $CO_2$ overnight. The next day 50 µL of medium containing different titrated concentrations of FAP-targeted or untargeted 4-1BB ligand trimer-containing Fc fusion antigen binding molecules were added. FAP-expressing tumor cells (MV3 and WM-266-4) were resuspended in medium to a concentration of $2 \times 10^6$ cells/ml. Suspension of FAP-expressing tumor cell (50 µl) was added to each well and plates were incubated for 6 hours at 37° C. and 5% $CO_2$. The principle of the assay is shown in FIGS. 19A and 19B. After incubation cells were washed three times with 200 µL/well DPBS. 40 µl freshly prepared Reporter Lysis Buffer (Promega, Cat-No: E3971) were added to each well and plates were stored over night at −20°

C. The next day frozen cell plates and detection buffer (Luciferase 1000 Assay System, Promega, Cat. No. E4550) were thawed to room temperature. 100 μL of detection buffer were added to each well and luciferase activity was measured as fast as possible using SpectraMax M5/M5e (Molecular Devices) microplate reader (500 ms integration time, no filter collecting all wavelength). Light emission was counted in units of released light (URL) for 0.5 sec/well and blotted against the concentration of tested FAP-targeted or untargeted 4-1BB ligand trimer-containing Fc fusion antigen binding molecules. The results for Constructs of Example 2 are shown in FIGS. 20A to 20F.

6.3 Antigen-Specific CD8+ T Cell-Based Assay

Isolation and Culture of Antigen-Specific CD8 T Cells

Fresh blood was obtained from a HLA-A2+ CMV-infected volunteer. PBMCs were isolated as described above. CD8 T cells were purified from PBMCs using a negative selection human CD8 T cell isolation Kit according to manufacturer's recommendations (Miltenyi Biotec, Cat. No. 130-094-156). Ten million of isolated CD8 T cells were resuspended in 1 mL sterile DPBS supplemented with 1% (v/v) FBS along with 50 μL of PE-labeled HLA-A2-pentamer containing the CMV-derived NLVPMVATV peptide (ProImmune, Cat. No. F008-2B) and incubated for 10 min at room temperature. Cells were washed twice with 3 mL sterile DPBS supplied with 1% (v/v) FBS. Cells were resuspended in 1 mL cells DPBS supplied with 1% (v/v) FBS containing 1 μg/mL anti-human CD8-FITC (clone LT8, Abcam, Cat. No. Ab28010) and incubated for 30 minutes at 4° C. Cells were washed twice, resuspended to a concentration of $5 \times 10^6$ cells/mL in DPBS supplied with 1% (v/v) FBS, and filtrated through a 30 μm pre-separation nylon-net cell strainer (Miltenyi Biotec, Cat. No. 130-041-407). NLV-peptide-specific CD8+ T cells were isolated by FACS sorting using an ARIA cell sorter (BD Bioscience with DIVA software) with the following settings: 100 μm nozzle and purity sort mask. Sorted cells were collected in a 15 ml polypropylene centrifuge tube (TPP, Cat. No. 91015) containing 5 ml RPMI 1640 medium supplied with 10% (v/v) FBS, 1% (v/v) GlutaMAX-I and 400 U/mL Proleukin. Sorted cells were centrifuged for 7 minutes at 350×g at room temperature and resuspended in same medium to a concentration of $0.53 \times 10^6$ cells/mL. 100 μL/well of this cell suspension were added to each well of a previously prepared feeder plate.

PHA-L-activated irradiated allogeneic feeder cells were prepared from PBMCs as previously described (Levitsky et al., 1998) and distributed to 96 well culture plates at $2 \times 10^5$ feeder cells per well.

After one day of culturing 100 μL medium/well were removed from well containing sorted CD8+ T-cells and replaced by new RPMI 1640 medium supplemented with 10% (v/v) FBS and 1% (v/v) GlutaMAX-I and 400 U/mL Proleukin, this was repeated during culture on a regular basis (every 2-4 days). As soon as cells start to proliferate, they were transferred to 24-well flat-bottom tissue culture plate (TPP, 92024). Cells were expanded/split and reactivated with new feeder cell preparation on a regular basis.

Activation Assay of Antigen-Specific CD8+ T Cells

Figure 21A:
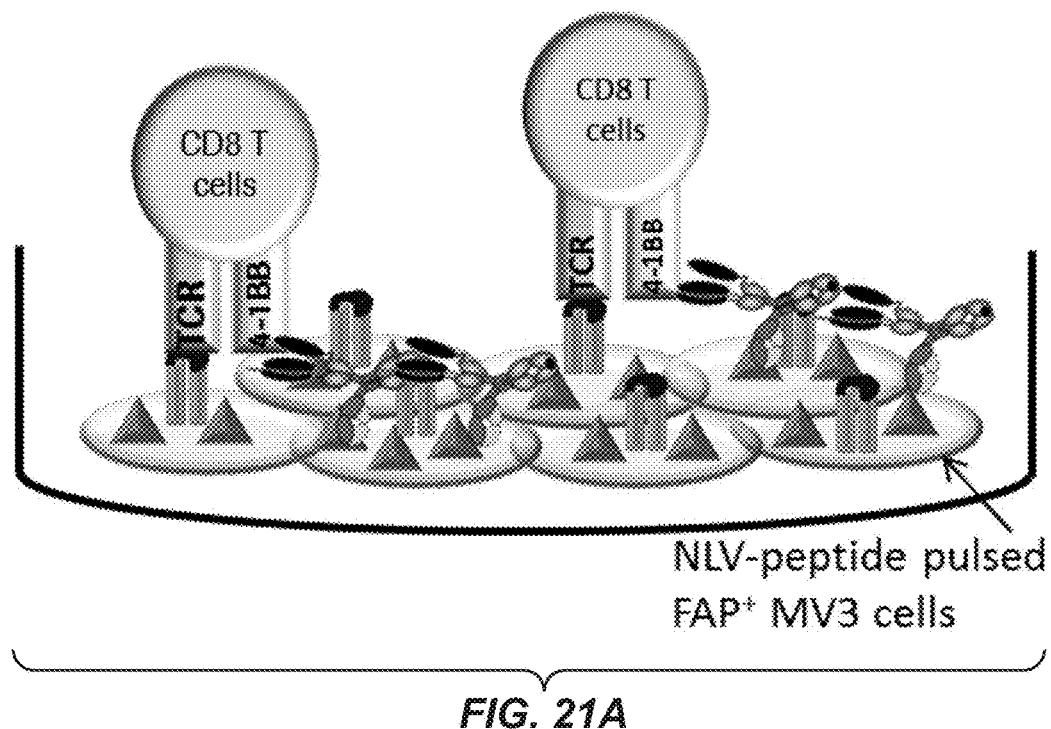
FIGS. 21A and 21B show a scheme illustrating the principal of the T-cell activation assay described in Example 6.3. Shown is the schematic assay activation set up with HLA-A2-NLV-specific CD8 T cells and NLV-pulsed HLA-A2+ FAP+ human melanoma cell line MV-3 in the presence of different titrated concentration of FAP-targeted or untargeted split trimeric human 4-1BB ligand Fc (kih) constructs. Cells were incubated for 28 h, the last 4 h in the presence of monesin-containing Golgi-Stop. The ratio of NLV-specific CD8 T cells to MV-3 tumor cells is 1:8.
Figure 21B:
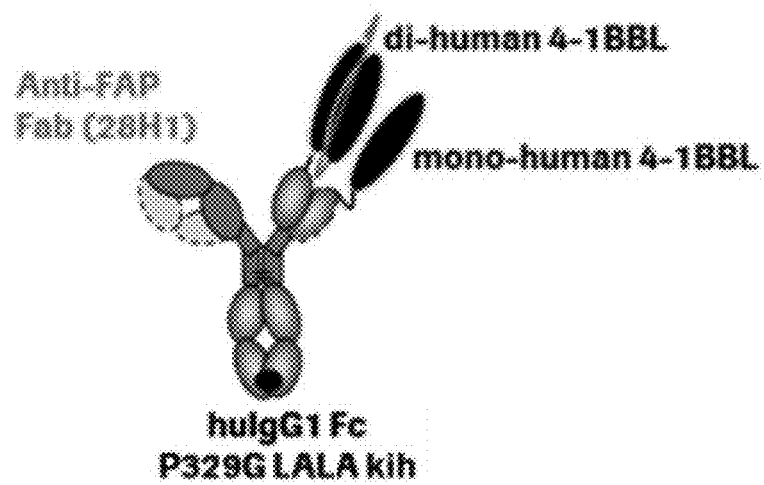
Figures 1, 22A:
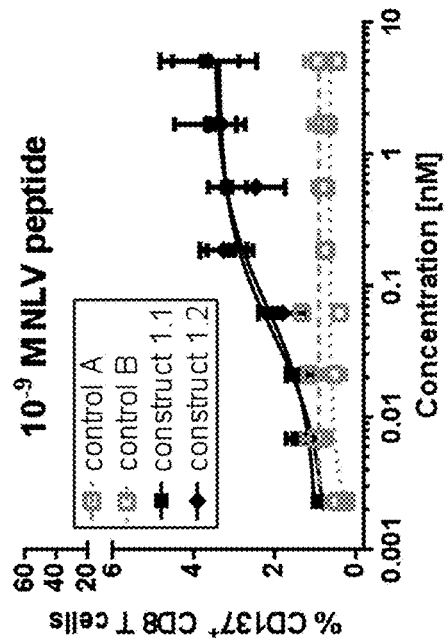
Figures 2, 22A:
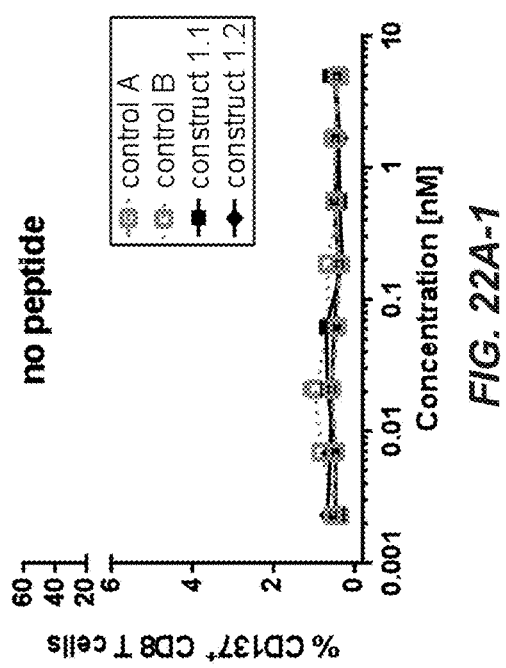
Figures 3, 22A:
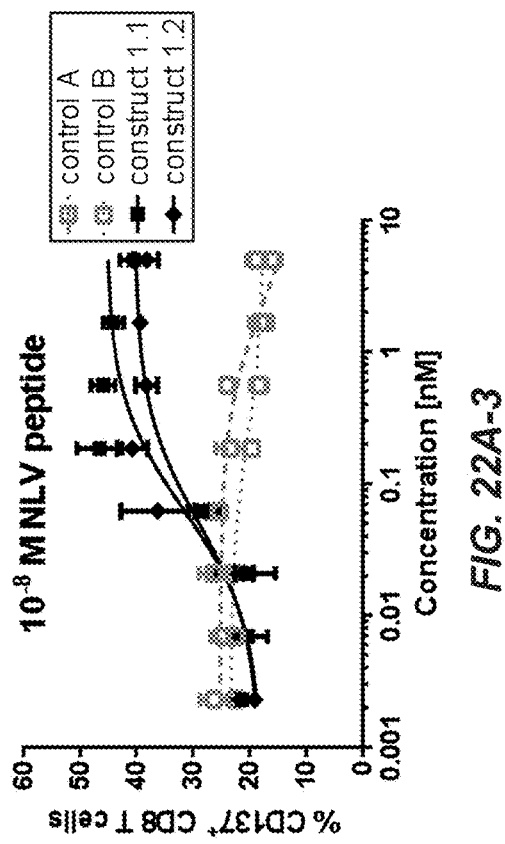
Figures 1, 22B:
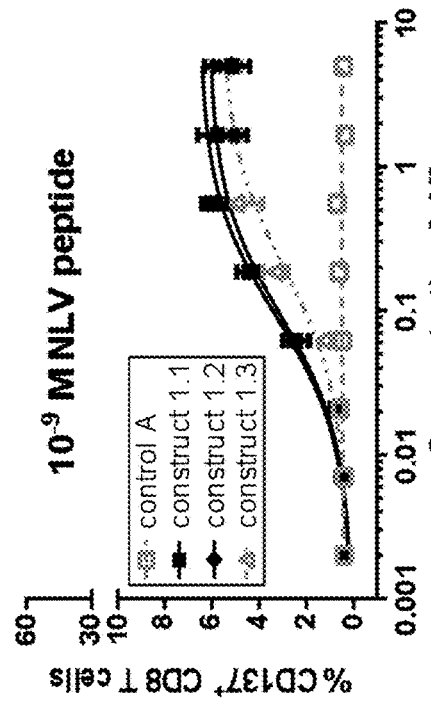
Figures 2, 22B:
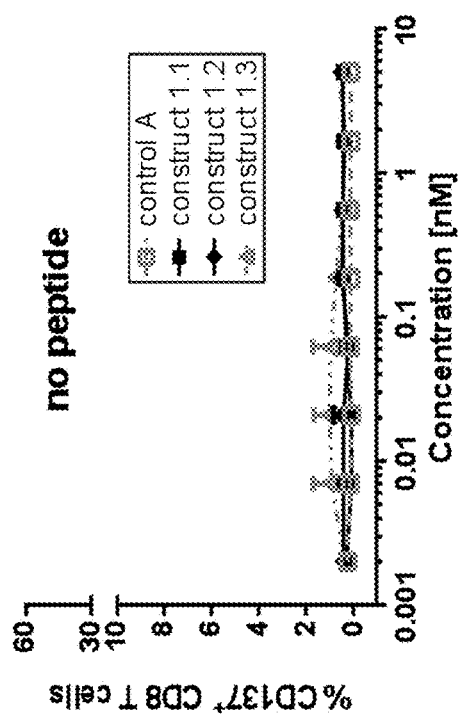
Figures 3, 22B:
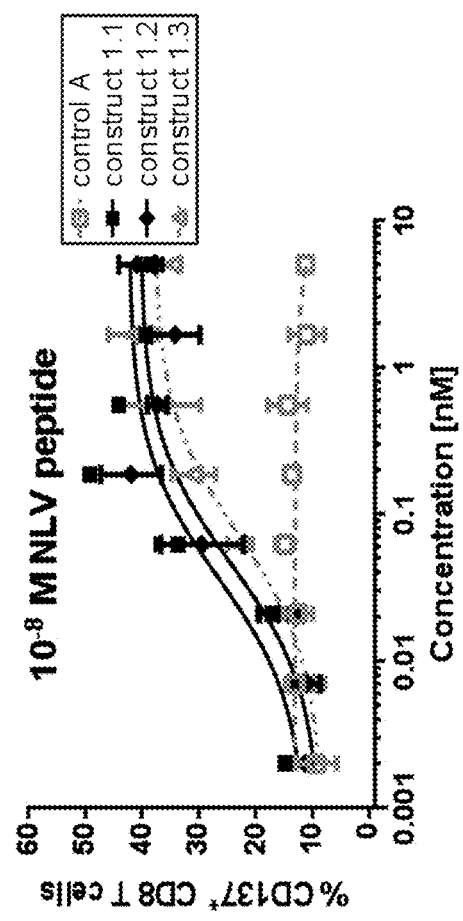
Figures 1, 24A:
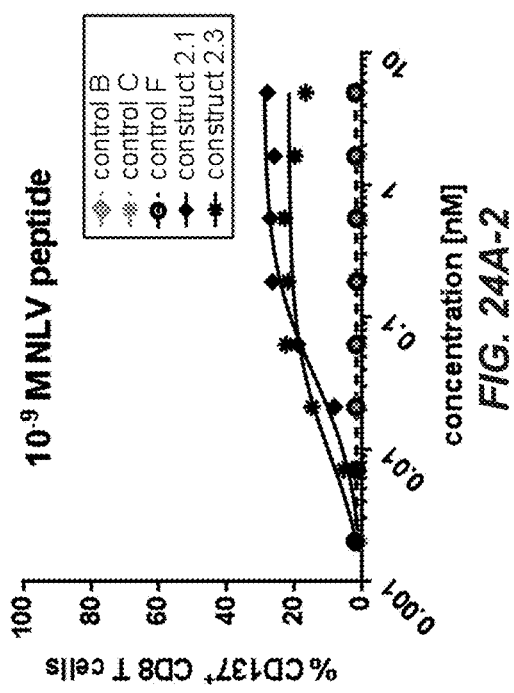
Figures 2, 24A:
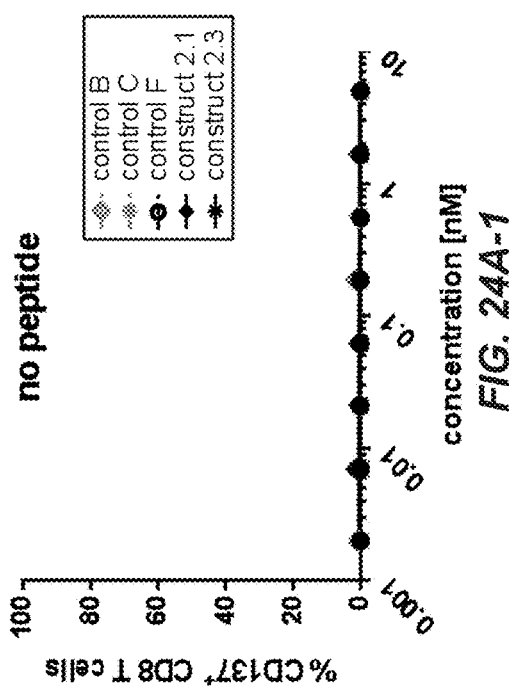
Figures 3, 24A:
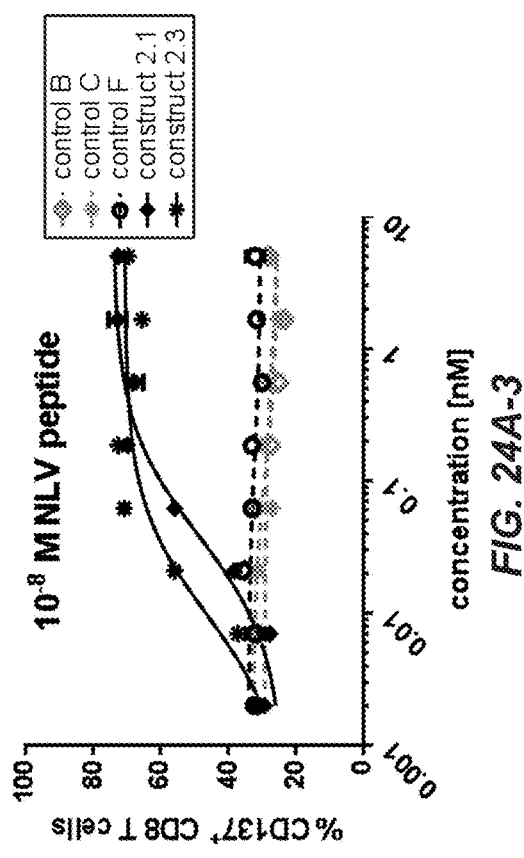

MV3 cells were harvested and washed with DPBS and $2 \times 10^7$ cells were resuspended in 250 μL C diluent of the PKH-26 Red Fluorescence Cell linker Kit (Sigma, Cat.-No. PKH26GL). 1 μL PKH26-Red-stain solution was diluted with 250 μL C diluent and added to the suspension of MV3 cells which were then incubated for 5 min at room temperature in the dark. This was followed by addition of 0.5 mL FBS and cells were incubated for 1 minute and washed once with T cell medium consisting of RPMI 1640 medium supplemented with 10% (v/v) FBS, 1% (v/v) GlutaMAX-I, 1 mM Sodium-Pyruvate, 1% (v/v) MEM non-essential amino acids and 50 μM β-Mercaptoethanol. $1 \times 10^6$ MV3 cells/mL were resuspended in T cell medium and separated into three tubes. Synthetic NLVPMVATV peptide (obtained from thinkpeptides) was added to a final concentration of $1 \times 10^{-9}$M or $1 \times 10^{-8}$M and cells were incubated for 90 min. MV3 cells were washed once with T cell medium and resuspended to a density of $0.5 \times 10^6$ cells/mL, distributed (100 μL/well) to a 96-well round bottom cell-suspension plate (Greiner bio-one, cellstar, Cat.-No. 650185) and incubated over night at 37° C. and 5% $CO_2$. The principle of the assay is shown in FIGS. 21A and 21B.

The next day, 50 μL/well T cell medium containing different titrated concentrations of targeted 4-1BB ligand trimer-containing Fc fusion antigen binding molecules were added. NLV-specific CD8 T cells were harvested, CFDA-SE (5(6)-Carboxyfluoresceindiacetate-N-succinimidylester, SIGMA-Aldrich, Cat.-No. 21888-25MG-F) was added to a final concentration of 40 nM and cells were incubated under rotation for 15 min at 37° C. Labeling was stopped by adding FBS, cells were washed and resuspended in T cell medium to a final concentration of $0.125 \times 10^6$ cells/mL. 50 μL of this CFSE-labeled CD8 T cell suspension were added to each well (final E:T ratio=1:8). Cell plates were incubated for 24 h, 50 μL/well were removed and 50 μL T cell medium containing 2.64 μL/mL Golgi stop (Protein Transport Inhibitor containing Monesin, BD Bioscience, Cat.-No. 554724) were added to each well (final concentration 0.66 μL/mL). Cells were incubated for 4 h and then plates were washed with 200 μL/well DPBS and stained with 100 μL/well 4° C. DPBS containing 1:5000 diluted Fixable Viability Dye-eF450 (eBioscience, Cat.-No. 65-0864) for 30 minutes at 4° C. Cell plates were washed with 200 μL/well DPBS followed by staining with fluorescent dye-conjugated antibodies: anti-human CD137-PerCP/Cy5.5 (clone 4B4-1, mouse IgG1κ, BioLegend, Cat.-No. 309814), anti-human CD8-BV605 (clone RPA-T8, mouse IgG1κ, BioLegend, Cat.-No. 301012) or 0.67 μg/mL anti-human CD8a-APC/Cy7 (clone RPA-T8, mouse IgG1κ, BioLegend, Cat.-No. 301016) and anti-human CD25 PE/Cy7 (clone BC96, mouse IgG1κ, BioLegend, Cat.-No. 302612). After incubation for 30 min at 4° C., cells were washed twice with 200 μL/well FACS buffer, resuspended in 50 μL/well freshly prepared FoxP3 Fix/Perm buffer (eBioscience Cat.-No. 00-5123 and 00-5223) and incubated for 30 min at 4° C. Plates were washed twice with 200 μL/well Perm-Buffer (DPBS supplied with 2% (v/v) FBS, 1% (w/v) saponin (Sigma Life Science, S7900) and 1% (w/v) sodium azide (Sigma-Aldrich, 52002) and stained with 50 μL/well Perm-Buffer (eBioscience, Cat.-No. 00-8333-56) containing 0.25 μg/mL anti-human IFNγ-APC (clone B27, mouse IgG1κ, BioLegend, Cat.-No. 506510) or 0.33 μg/mL anti-human IFNγ-BV510 (clone 4S.B3, mouse IgG1κ, BioLegend, Cat.-No. 502543). Plates were incubated for 1 h at 4° C. and washed twice with 200 μL/well Perm-Buffer. For fixation, 50 μL/well DPBS containing 1% formaldehyde were added. The same or the next day, cells were resuspended in 100 μL/well FACS buffer and acquired using a 5-laser FORTESSA® flow cytometer (BD Bioscience with DIVA software) or 3-laser Miltenyi Quant Analyzer 10 (Miltenyi Biotec) and Flow Jo (FlowJo X 10.0.7).

As shown in FIGS. 22A-1 to 22E-3. and FIGS. 23 A-1 to 23E-3. for Constructs 1.1 to 1.10 and in FIGS. 24A-1 to 24B-3. and 25A-1 to 25B-3 for Constructs 2.1, 2.3 and 2.4, antigen-specific CD8+ T cells, but not unstimulated controls, exhibited increased levels of surface 4-1BB expression in the presence of FAP-targeted 4-1BB ligand trimer-containing Fc fusion antigen binding molecule (FAP split 4-1BBL trimer). This effect of 4-1BBL was dose dependent and required FAP-targeting as addition of the untargeted control molecule did not affect the level of 4-1BB expression. Furthermore, T-cells activated at the higher peptide concentration ($1\times10^{-8}$M) showed sustained secretion of INFγ in the presence of FAP-targeted 4-1BB ligand trimer-containing Fc fusion antigen binding molecule (FAP split 4-1BBL trimer). Collectively, these data demonstrate that the antigen-targeted 4-1BB ligand trimer-containing Fc fusion antigen binding molecule modulates the surface phenotype and responsiveness of antigen specific T-cells in a targeting dependent manner.

6.4 Comparison of Cell-Targeted and Untargeted Mouse 4-1BBL Fc Fusion Antigen Binding Molecules Targeted and untargeted mouse 4-1BB ligand trimer-containing Fc fusion antigen binding molecules (FAP split mouse 4-1BBL trimer and DP47 split mouse 4-1BBL trimer) were prepared as described in Example 1.3.

Figure 26A:
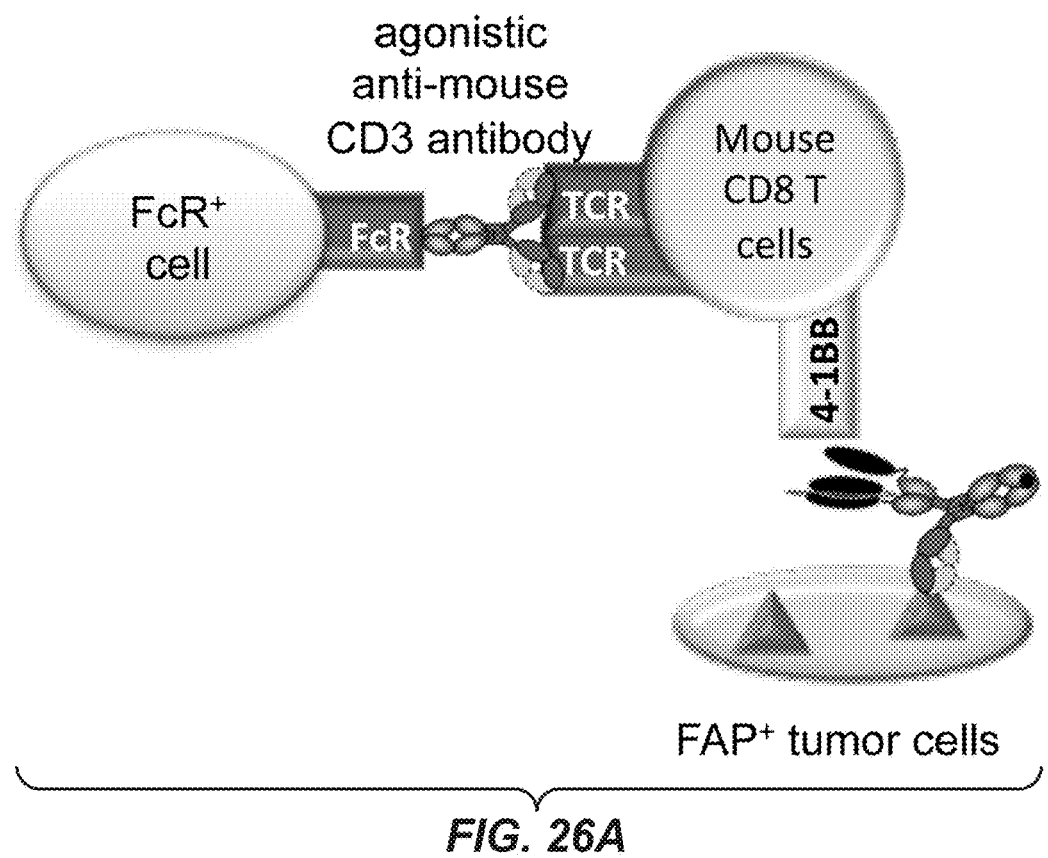
FIGS. 26A and 26B show a scheme illustrating the experiment as described in Example 6.4.
Figure 26B:
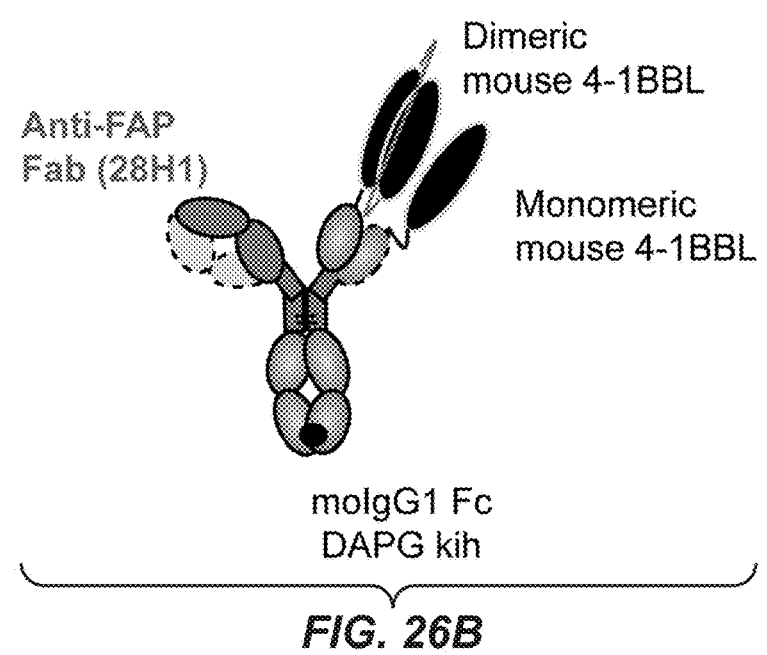

To compare the bioactivity of cell-targeted and untargeted mouse 4-1BB ligand trimer-containing Fc fusion antigen binding molecules, Proliferation Dye EFLUOR® 670-labeled (eBioscience, Cat.-No. 65-0840-90) or CellTrace Violet Cell Proliferation dye-labeled (Cell tracer, Cat.-No. C34557) fresh mouse splenocytes were cocultured for 3-4 days in 96 well tissue culture U-bottom plates (TTP, Cat.-No. 92097) with adherent 50 Gy irradiated NIH/3T3-huFAP clone 39 cells (generation see 5.3) in RPMI 1640 medium (Gibco, Cat.-No. 42401-042) supplied with 10% (v/v) FBS, 1% (v/v) GlutaMAX-I, 1 mM Sodium-Pyruvate, 1% (v/v) MEM non-essential amino acids and 50 µM β-Mercaptoethanol in the presence of 0.5 µg/mL anti-mouse CD3 Syrian hamster IgG (clone 145-2C11, BD, Cat.-No. 553057) and the indicated drug candidate molecule added at a range of concentrations (FIGS. 26A and 26B). After three or four days, cells were washed with FACS buffer and stained for 30 min at 4° C. in 25 uL FACS buffer/well containing anti-mouse CD8 ratIgG2a-BV711 (BioLegend, Cat.-No. 100747, clone 53-6.7,) and anti-mouse CD4 ratIgG2a-BV421 (BioLegend, Cat.-No. 100544, clone RM4-5) and 0.67 µg/mL anti-mouse CD137 (4-1BB) Syrian hamster IgG-PE (BioLegend, Cat.-No. 106106, clone 17B5) and anti-mouse CD25-PErCP-Cy5.5 ratIgG2b (BioLegend, Cat.-No. 1019112).

Figure 27:
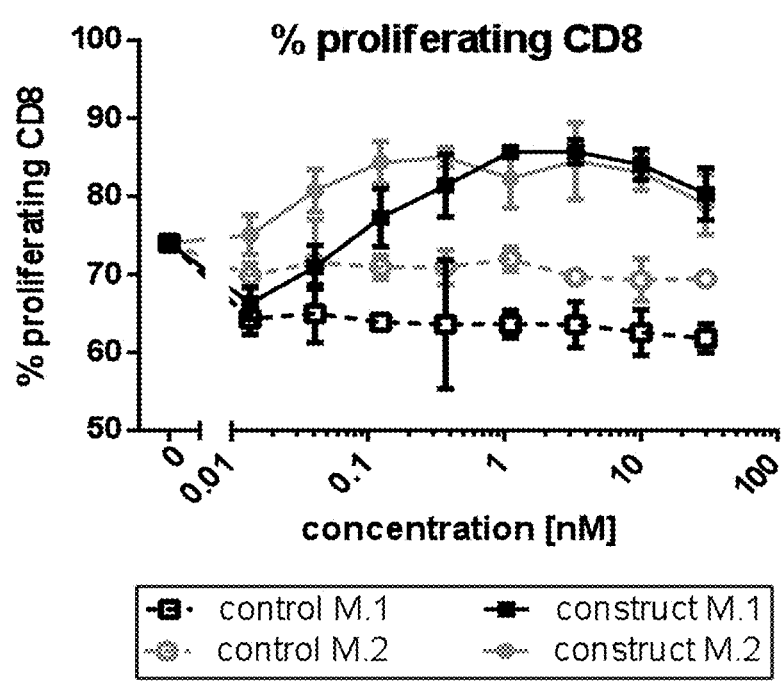
FIG. 27 shows the induction of CD8+ T cell proliferation. Shown is the frequency of proliferating CD8+ T cells versus the concentration of tested constructs.

Cells were washed and incubated for 1 h at room temperature in prepared Fix/Perm Buffer (Foxp3/Transcription Factor Staining Buffer Set, eBioscience, Cat.-Ni. 00-5523-00). Cells were washed twice with freshly prepared Perm buffer and co-stained with 25 µL/well Perm-buffer containing fluorescently-labeled antibodies against the cytotoxic lineage transcription factor Eomes, i.e. anti-mouse Eomes ratIgG2a ALEXA FLUOR® 488 (eBioscience, Cat.-No. 534875, clone Dan11mag) and—if CD137 was not stained—against the cytotoxic effector molecule granzyme B, i.e. anti-mouse ratIgG2a granzyme B-PE (eBioscience, Cat.-No. 128822, clone 16G6) for 1 h at room temperature. Cells were then washed twice, resuspended in FACS buffer and acquired using laser FORTESSA® flow cytometer (BD Bioscience with DIVA software) or the 3-laser MACSQuant Analyzer 10 (Miltenyi Biotech) and Flow Jo v10.0.7 (FlowJo LLC). Gates were set on living CD8+ T cells and CD4+ T cells and the frequency of proliferating cells was determined as well as the expression levels of CD25, Eomes and granzyme B or CD137. The proliferation frequency and frequencies and MFIs of activation markers were blotted against the concentration of used mouse 4-1BB ligand trimer-containing Fc(kih) fusion molecules to display the functional activity. As can be seen in FIG. 27, an increase in proliferating CD8+ T cells could be observed for Constructs M.1 and M.2.

6.5 Liver Changes in Mice Treated with Anti-Murine 4-1BB Antibody Lob 12.3 (muIgG1 Wt) or with Construct M.2

C57BL/6 mice bearing MC38-muFAP (murine colorectal cancer model) s.c. were treated once per week for 3 weeks with agonistic anti-murine 4-1BB antibodies targeted to FAP (Efficacy Study 020-GA1401: "Experiment to show efficacy of 4-1BB targeted therapy in combination with a-PD-L1 in MC38-muFAP s.c. model in C57B6 mice."). Antibodies used were Lob 12.3 muIgG1 Wt (with "wildtype" Fc, clone Lob 12.3 from BioXcell Catalog#: BE0169) or Construct M.2 with DAPG mutation (inactive Fc). The two antibodies were administered once weekly for three consecutive weeks. Four animals/group were sacrificed 7 days after last treatment and livers examined microscopically.

Liver changes were observed only in animals receiving Lob 12.3 muIgG1 Wt, consisting in foci of hepatocellular degeneration with accumulation of F4/80 positive macrophages and a lower amount of mixed population of inflammatory cells (mainly lymphocytes) frequently showing a vasocentric distribution. Occasionally single cell necrosis of hepatocytes, and perivascular mononuclear cell infiltrates in portal spaces were noted. No treatment related findings were observed in the liver of animals receiving Construct M.2 (Table 41).

TABLE 41

Incidence of Histopathogical Findings (n = 4/group)

| Treatment | Vehicle | Lob 12.3 muIgG1 Wt | Construct M.2 |
|---|---|---|---|
| Foci of hepatocellular degeneration with macrophages and inflammatory cells | — | 4 | — |
| Perivascular inflammatory cells infiltrates | — | 4 | — |
| Single cell necrosis | — | 4 | — |

Hepatitis, attributed to crosslinking by FcγRs in the liver, has been observed in patients treated with Urelumab BMS-663513 (Ascierto P. A. et al. 2010) and in mouse using the mouse surrogate. The absence of liver findings in animals treated with an antibody with inactive Fc support this hypothesis.

6.6 Determination of Pharmacokinetic Parameters of Human 4-1BB Ligand Trimer-Containing Fc Fusion Antigen Binding Molecules In order to test if the human 4-1BB ligand trimer-containing Fc fusion antigen binding molecules of the invention are suitable for pharmaceutical use, the pharmacokinetic parameters (PK data) such as clearance, volume of distribution or elimination half-time ($t_{1/2}$) in mice were determined. Thus, the following experiments were carried out:

Experiment A: Single Dose PK of Construct 1.2 and Control B in Healthy NOG Mice

NOG female mice at an average age of 8 to 10 weeks at start of experiment (purchased from Taconic, SOPF facility) were maintained under specific-pathogen-free condition with daily cycles of 12 h light/12 h darkness according to committed guidelines (GV-Solas; Felasa; TierschG). Experimental study protocol was reviewed and approved by local government (P 2011128). After arrival animals were maintained for one week to get accustomed to new environment and for observation. Continuous health monitoring was carried out on regular basis.

Figure 28A:
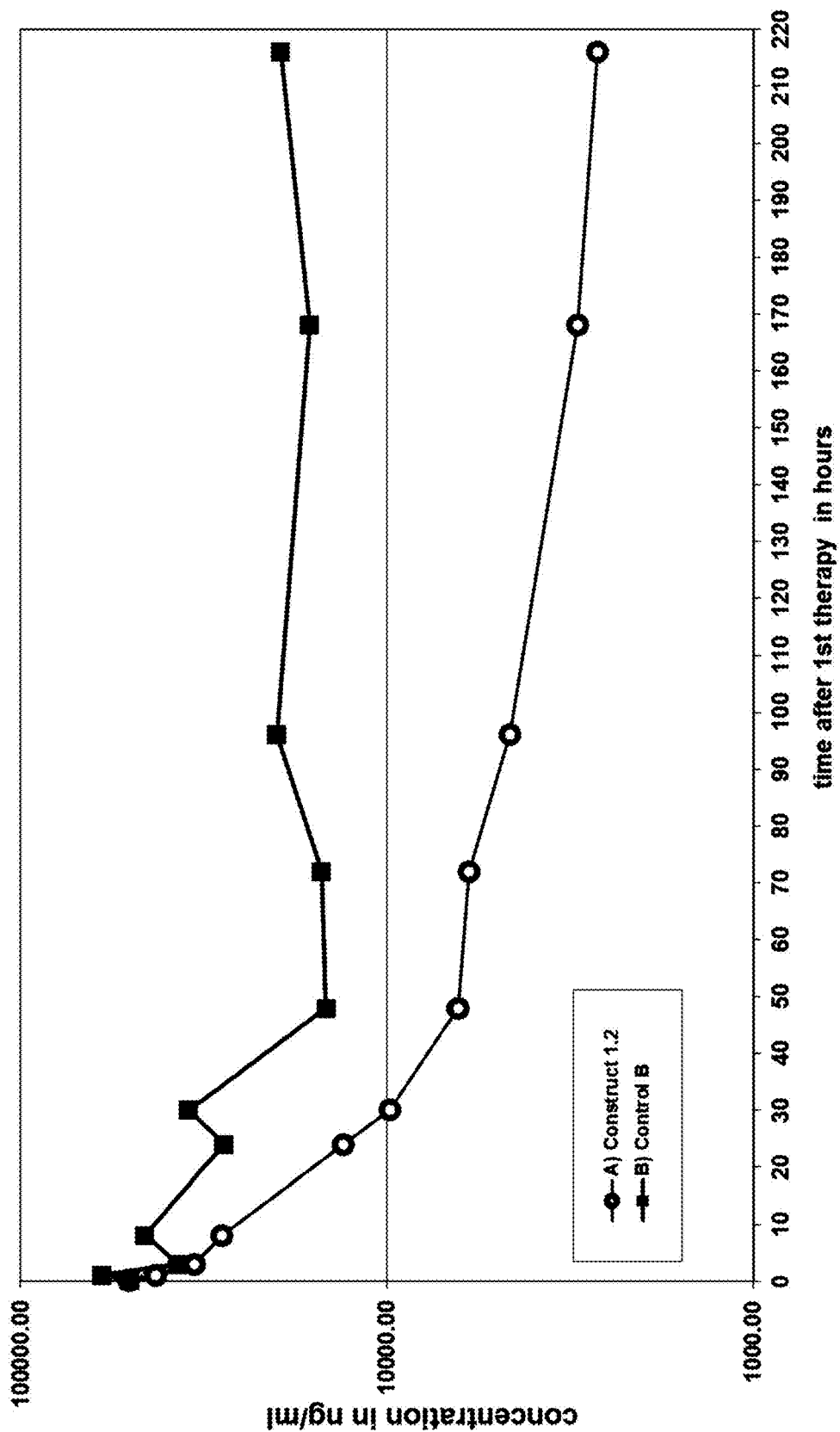
FIG. 28A relates to the single dose PK experiment of Construct 1.2 and Control B in healthy NOG mice. Shown is the decline in Construct concentration over the time.

A single dose pharmacokinetic study (SDPK) was performed to evaluate exposure of Construct 1.2 and Control B. An i.v. bolus administration of 2.5 mg/kg was administered to NOG mice and blood samples were taken at selected time points for pharmacokinetic evaluation. Mouse serum samples were analyzed by ELISA. Biotinylated human 4-1BB, test samples, Digoxygenin labelled anti-huCH1 antibody and anti-Digoxygenin detection antibody (POD) were added stepwise to a 96-well streptavidin-coated microtiter plate and incubated after every step for 1 h at room temperature. The plate was washed three times after each step to remove unbound substances. Finally, the peroxidase-bound complex was visualized by adding ABTS substrate solution to form a colored reaction product. The reaction product intensity which was photometrically determined at 405 nm (with reference wavelength at 490 nm) is proportional to the analyte concentration in the serum sample. The calibration range of the standard curve for the constructs was 0.156 to 10 ng/ml, where 3 ng/ml is the lower limit of quantification (LLOQ). FIG. 28A shows the decrease in concentration over the time as observed in this experiment.

Experiment B: Single Dose PK of Constructs 2.1, 2.3, Control B and Control C in Tumor Bearing NOG Mice Humaniced with Stem Cells A single dose pharmacokinetic study (SDPK) was performed to evaluate exposure of Construct 2.1, 2.3, Control B and Control C. NSG female mice transferred with human stem cells were delivered by Jackson Laboratories. Mice were maintained under specific-pathogen-free condition with daily cycles of 12 h light/12 h darkness according to committed guidelines
(GV-Solas; Felasa; TierschG). Experimental study protocol was reviewed and approved by local government (ZH193-2014). After arrival animals were maintained for one week to get accustomed to new environment and for observation. Continuous health monitoring was carried out on regular basis.

Figure 28B:
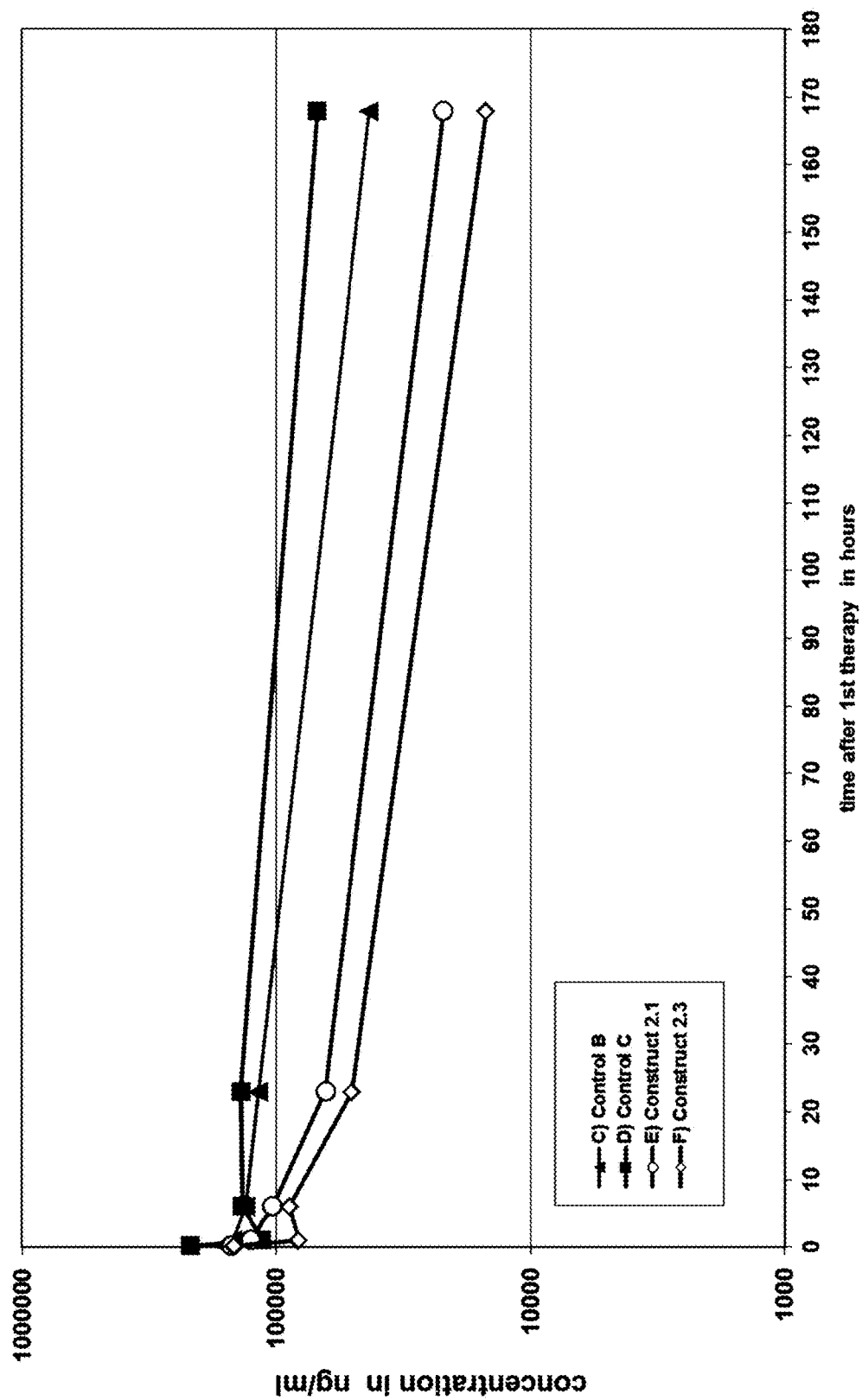
FIG. 28B shows the results of the single dose PK experiment of Constructs 2.1, 2.3, Control B and Control C in tumor bearing NOG mice humaniced with stem cells.

Human MKN45 cells (human gastric carcinoma) were originally obtained from ATCC and after expansion deposited in the Glycart internal cell bank. Cells were cultured in DMEM containing 10% FCS. Cells were cultured at 37° C. in a water-saturated atmosphere at 5% $CO_2$. In vitro passage 9 was used for subcutaneous injection, at a viability of 97%. Human fibroblasts NIH-3T3 were engineered at Roche Nutley to express human FAP. Clone 39 was used at an in vitro passage number 12 and at a viability of 98%. 50 microliters cell suspension (1×106 MKN45 cells+1×106 3T3-huFAP) mixed with 50 microliters Matrigel were injected subcutaneously in the flank of anaesthetized mice. An i.v. bolus administration of 10 mg/kg was administered to humaniced mice when tumor reached an average size of 190 $mm^3$. Blood samples were taken at selected time points for pharmacokinetic evaluation. Mouse serum samples were analyzed by ELISA. Biotinylated human 4-1BB, test samples, Digoxygenin labelled anti-huCH1 antibody and anti-Digoxygenin detection antibody (POD) were added stepwise to a 96-well streptavidin-coated microtiter plate and incubated after every step for 1 h at room temperature. The plate was washed three times after each step to remove unbound substances. Finally, the peroxidase-bound complex is visualized by adding ABTS substrate solution to form a colored reaction product. The reaction product intensity which was photometrically determined at 405 nm (with reference wavelength at 490 nm) is proportional to the analyte concentration in the serum sample. The calibration range of the standard curve for the constructs was 0.156 to 10 ng/ml, where 3 ng/ml is the lower limit of quantification (LLOQ). FIG. 28B shows the decrease in concentration of the constructs over the time as observed in this experiment.

Experiment C: Single Dose PK of Construct 2.1 and 2.3 in Healthy NOG Mice

NOG female mice at an average ager of 8-10 weeks at start of experiment (purchased from Taconic, SOPF facility) were maintained under specific-pathogen-free condition with daily cycles of 12 h light/12 h darkness according to committed guidelines (GV-Solas; Felasa; TierschG). Experimental study protocol was reviewed and approved by local government (P 2011128). After arrival animals were maintained for one week to get accustomed to new environment and for observation. Continuous health monitoring was carried out on regular basis.

Figure 28C:
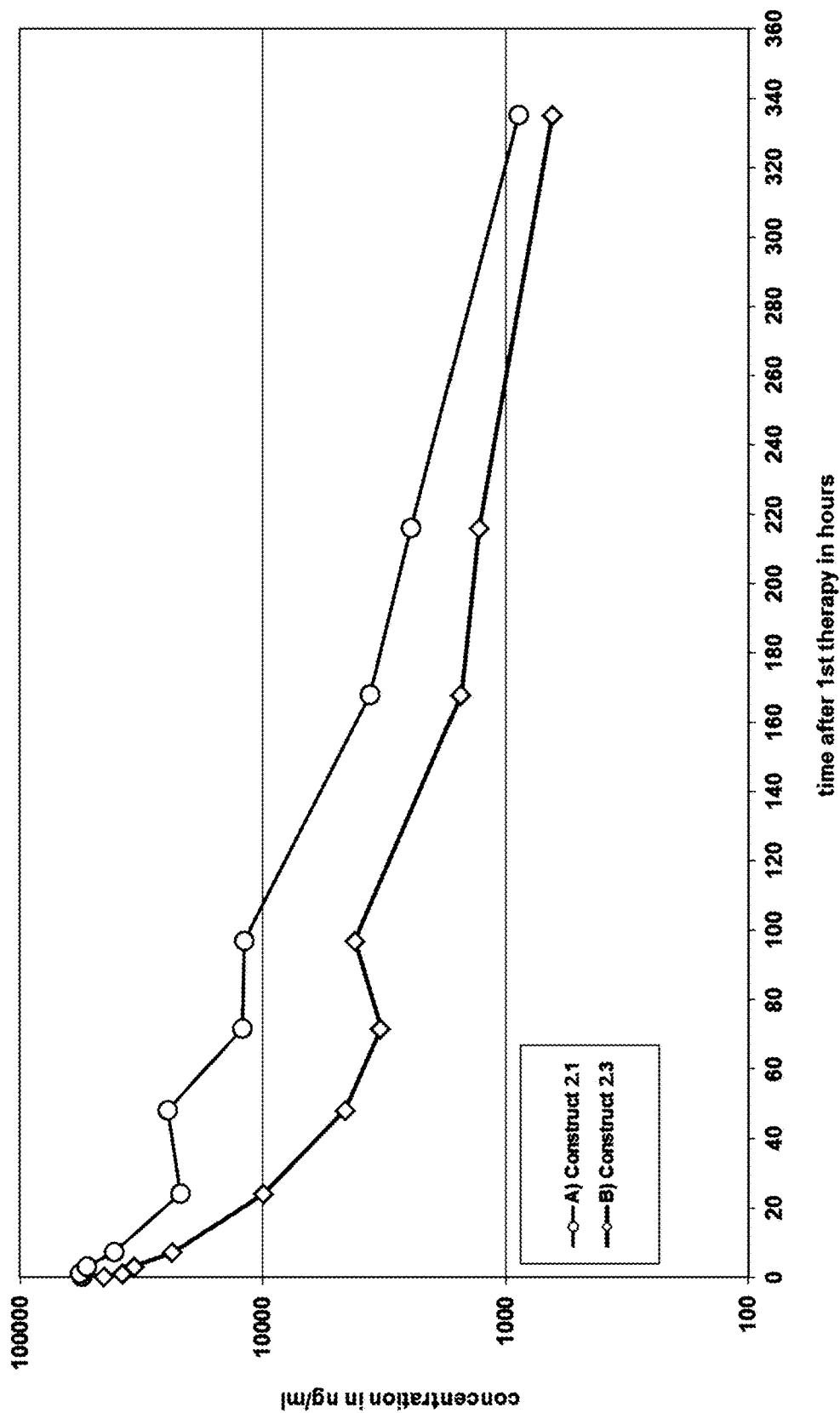
FIG. 28C relates to the single dose PK experiment comparing Construct 2.1 and 2.3 in healthy NOG mice.

A single dose pharmacokinetic study (SDPK) was performed to evaluate exposure of Construct 2.1 and 2.3. An i.v. bolus administration of 2.5 mg/kg was administered to NOG mice and blood samples were taken at selected time points for pharmacokinetic evaluation. Mouse serum samples were analyzed by ELISA. Biotinylated human 4-1BB, test samples, Digoxygenin labelled anti-huCH1 antibody and anti-Digoxygenin detection antibody (POD) were added stepwise to a 96-well streptavidin-coated microtiter plate and incubated after every step for 1 h at room temperature. The plate is washed three times after each step to remove unbound substances. Finally, the peroxidase-bound complex is visualized by adding ABTS substrate solution to form a colored reaction product. The reaction product intensity, which is photometrically determined at 405 nm (with reference wavelength at 490 nm), is proportional to the analyte concentration in the serum sample. The calibration range of the standard curve for the constructs was 0.156 to 10 ng/ml, where 3 ng/ml is the lower limit of quantification (LLOQ). FIG. 28C shows the observed decrease in concentration over the time.

The tested constructs 2.1 and 2.3 are stable enough in the body and possess PK parameters in a suitable range for pharmaceutical development. It can also be concluded from the results that construct 2.1 is slightly more stable.

6.7 FAP Prevalence in Human Tumors

The prevalence of FAP in human tumors was evaluated as described in WO 2014/161845 to get an understanding on possible clinical use of FAP-targeted constructs.

Rat anti-human Seprase antibody (IgG2a, clone D8) from Vitatex (MABS1001) was used to immunostain 2.5 μm FFPET sections from various tumour indications on the Ventana Benchmark XT. Sections were subjected to standard CC1 treatment followed by antibody incubation for 60' at 37° C. at a concentration of 5 μg/mL in Dako antibody diluent (S3022) and positive staining was detected using the Ultraview DAB detection system (Ventana #760-4456). Matched isotype antibody from Abcam (ab18450) was used as the negative control. FAP+ stromal infiltrate was present in human tumors of different indications including head and neck squamous cell carcinoma (HNSCC), breast cancer, colorectal cancer (CRC), pancreatic cancer (PAC), gastric cancer, non-small-cell lung carcinoma (NSCLC) and Mesothelioma marking potentially interesting clinical indications for a FAP-targeted constructs (Table 42).

TABLE 42

FAP prevalence in human tumors

| Tumor Type | % cases with moderate to high grade of FAP+ infiltrate | No. of samples investigated |
| --- | --- | --- |
| HNSCC | 90 | 10 |
| Breast Cancer | 77 | 105 |
| triple negative BC | 80 | 7 |
| CRC | 77 | 90 |
| PAC | 74 | 19 |
| Gastric Cancer | 68 | 28 |
| NSCLC | 66 | 90 |
| Mesothelioma | 60 | 10 |

Example 7

7.1 Preparation of CD19 (8B8-018) Targeted 4-1BB Ligand Trimer-Containing Fc Fusion Antigen Binding Molecules

7.1.1 Preparation, Purification and Characterization of CD19 Antigen Fc Fusion for Phage Display Campaign In order to express and purify the human and cynomolgus CD19 ectodomain in a monomeric state (human CD19 see SEQ ID NO:31), the respective DNA fragment was fused to a human IgG1 Fc gene segment containing the "knob" mutations (human: SEQ ID NO: 186; cynomolgus: SEQ ID NO: 188) and was transfected with an "Fc-hole" (SEQ ID NO: 86) counterpart (Merchant et al., 1998). An IgA cleavage site (PTPPTP) was introduced between an antigen ectodomain and the Fc knob chain. An Avi tag for directed biotinylation was introduced at the C-terminus of the antigen-Fc knob chain and mutations H435R and Y436F were introduced in the Fc hole for purification purposes (Jendeberg L. et al, J. Immunological methods, 1997). Combination of the antigen-Fc knob chain containing the S354C/T366W mutations (human: SEQ ID NO: 187; cynomolgus: SEQ ID NO: 189), with a Fc hole chain containing the Y349C/T366S/L368A/Y407V mutations (SEQ ID NO: 90) allows generation of a heterodimeric Fc fusion fragment which includes a single copy of the CD19 ectodomain (in analogy to the 4-1BB construct in FIG. 5C). Table 43 lists the cDNA and amino acid sequences of the antigen Fc-fusion construct.

TABLE 43 cDNA and Amino acid sequences of monomeric human and cynomolgus CD19 antigen Fc(kih) fusion molecule

| SEQ ID NO: | Antigen | Sequence |
| --- | --- | --- |
| 86 | Nucleotide sequence Fc hole chain | see Table 32 |
| 186 | Nucleotide sequence human CD19 antigen Fc knob chain avi tag | CCCGAGGAACCCCTGGTCGTGAAGGTGGAAGAGGGCGACAAT GCCGTGCTGCAGTGCCTGAAGGGCACCTCCGATGGCCCTACC CAGCAGCTGACCTGGTCCAGAGAGAGCCCCCTGAAGCCCTTC CTGAAGCTGTCTCTGGGCCTGCCTGGCCTGGGCATCCATATG AGGCCTCTGGCCATCTGGCTGTTCATCTTCAACGTGTCCCAG CAGATGGGCGGCTTCTACCTGTGTCAGCCTGGCCCCCCATCT GAGAAGGCTTGGCAGCCTGGCTGGACCGTGAACGTGGAAGGA TCCGGCGAGCTGTTCCGGTGGAACGTGTCCGATCTGGGCGGC CTGGGATGCGGCCTGAAGAACAGATCTAGCGAGGGCCCCAGC AGCCCCAGCGGCAAACTGATGAGCCCCAAGCTGTACGTGTGG GCCAAGGACAGACCCGAGATCTGGGAGGGCGAGCCTCCTTGC CTGCCCCCTAGAGACAGCCTGAACCAGAGCCTGAGCCAGGAC CTGACAATGGCCCCTGGCAGCACACTGTGGCTGAGCTGTGGC GTGCCACCCGACTCTGTGTCTAGAGGCCCTCTGAGCTGGACC CACGTGCACCCTAAGGGCCCTAAGAGCCTGCTGAGCCTGGAA CTGAAGGACGACAGGCCCGCCAGAGATATGTGGGTCATGGAA ACCGGCCTGCTGCTGCCTAGAGCCACAGCCCAGGATGCCGGC AAGTACTACTGCCACAGAGGCAACCTGACCATGAGCTTCCAC CTGGAAATCACCGCCAGACCCGTGCTGTGGCACTGGCTGCTG AGAACAGGCGGCTGGAAGGTCGACGCTAGCGGTGGTAGTCCG ACACCTCCGACACCCGGGGGTGGTTCTGCAGACAAAACTCAC ACATGCCCACCGTGCCCAGCACCTGAAGCCGCAGGGGGACCG TCAGTCTTCCTCTTCCCCCCAAAACCCAAGGACACCCTCATG ATCTCCCGGACCCCTGAGGTCACATGCGTGGTGGTGGACGTG AGCCACGAAGACCCTGAGGTCAAGTTCAACTGGTACGTGGAC GGCGTGGAGGTGCATAATGCCAAGACAAAGCCGCGGGAGGAG CAGTACAACAGCACGTACCGTGTGGTCAGCGTCCTCACCGTC CTGCACCAGGACTGGCTGAATGGCAAGGAGTACAAGTGCAAG GTCTCCAACAAAGCCCTCGGAGCCCCCATCGAGAAAACCATC TCCAAAGCCAAAGGGCAGCCCCGAGAACCACAGGTGTACACC CTGCCCCCATGCCGGGATGAGCTGACCAAGAACCAGGTCAGC CTGTGGTGCCTGGTCAAAGGCTTCTATCCCAGCGACATCGCC GTGGAGTGGGAGAGCAATGGGCAGCCGGAGAACAACTACAAG ACCACGCCTCCCGTGCTGGACTCCGACGGCTCCTTCTTCCTC TACAGCAAGCTCACCGTGGACAAGAGCAGGTGGCAGCAGGGG AACGTCTTCTCATGCTCCGTGATGCATGAGGCTCTGCACAAC CACTACACGCAGAAGAGCCTCTCCCTGTCTCCGGGTAAATCC GGAGGCCTGAACGACATCTTCGAGGCCCAGAAGATTGAATGG CACGAG |
| 90 | Polypeptide sequence Fc hole chain | see Table 32 |
| 187 | Polypeptide sequence human CD19 antigen Fc knob chain avi tag | PEEPLVVKVEEGDNAVLQCLKGTSDGPTQQLTWSRESPLKPF LKLSLGLPGLGIHMRPLAIWLFIFNVSQQMGGFYLCQPGPPS EKAWQPGWTVNVEGSGELFRWNVSDLGGLGCGLKNRSSEGPS SPSGKLMSPKLYVWAKDRPEIWEGEPPCLPPRDSLNQSLSQD LTMAPGSTLWLSCGVPPDSVSRGPLSWTHVHPKGPKSLLSLE LKDDRPARDMWVMETGLLLPRATAQDAGKYYCHRGNLTMSFH LEITARPVLWHWLLRTGGWKVDASGGSPTPPTPGGGSADKTH TCPPCPAPEAAGGPSVFLFPPKPKDTLMISRTPEVTCVVVDV |

TABLE 43-continued cDNA and Amino acid sequences of monomeric human and cynomolgus CD19 antigen Fc(kih) fusion molecule

| SEQ ID NO: | Antigen | Sequence |
|---|---|---|
| | | SHEDPEVKFNWYVDGVEVHNAKTKPREEQYNSTYRVVSVLTV<br>LHQDWLNGKEYKCKVSNKALGAPIEKTISKAKGQPREPQVYT<br>LPPCRDELTKNQVSLWCLVKGFYPSDIAVEWESNGQPENNYK<br>TTPPVLDSDGSFFLYSKLTVDKSRWQQGNVFSCSVMHEALHN<br>HYTQKSLSLSPGKSGGLNDIFEAQKIEWHE |
| 188 | Nucleotide sequence cynomolgus CD19 antigen Fc knob chain avi tag | CCCCAGGAACCCCTGGTCGTGAAGGTGGAAGAGGGCGACAAT<br>GCCGTGCTCCAGTGCCTGGAAGGCACCTCCGATGGCCCTACA<br>CAGCAGCTCGTGTGGTGCAGAGACAGCCCCTTCGAGCCCTTC<br>CTGAACCTGTCTCTGGGCCTGCCTGGCATGGGCATCAGAATG<br>GGCCCTCTGGGCATCTGGCTGCTGATCTTCAACGTGTCCAAC<br>CAGACCGGCGGCTTCTACCTGTGTCAGCCTGGCCTGCCAAGC<br>GAGAAGGCTTGGCAGCCTGGATGGACCGTGTCCGTGGAAGGA<br>TCTGGCGAGCTGTTCCGGTGGAACGTGTCCGATCTGGGCGGC<br>CTGGGATGCGGCCTGAAGAACAGAAGCAGCGAGGGCCCTAGC<br>AGCCCCAGCGGCAAGCTGAATAGCAGCCAGCTGTACGTGTGG<br>GCCAAGGACAGACCCGAGATGTGGGAGGGCGAGCCTGTGTGT<br>GGCCCCCCTAGAGATAGCCTGAACCAGAGCCTGAGCCAGGAC<br>CTGACAATGGCCCCTGGCAGCACACTGTGGCTGAGCTGTGGC<br>GTGCCACCCGACTCTGTGTCCAGAGGCCCTCTGAGCTGGACA<br>CACGTGCGGCCAAAGGGCCCTAAGAGCAGCCTGCTGAGCCTG<br>GAACTGAAGGACGACCGGCCCGACCGGGATATGTGGGTGGTG<br>GATACAGGCCTGCTGCTGACCAGAGCCACAGCCCAGGATGCC<br>GGCAAGTACTACTGCCACAGAGGCAACTGGACCAAGAGCTTT<br>TACCTGGAAATCACCGCCAGACCCGCCCTGTGGCACTGGCTG<br>CTGAGAATCGGAGGCTGGAAGGTCGACGCTAGCGGTGGTAGT<br>CCGACACCTCCGACACCCGGGGGTGGTTCTGCAGACAAAACT<br>CACACATGCCCACCGTGCCCAGCACCTGAAGCCGCAGGGGGA<br>CCGTCAGTCTTCCTCTTCCCCCCAAAACCCAAGGACACCCTC<br>ATGATCTCCCGGACCCCTGAGGTCACATGCGTGGTGGTGGAC<br>GTGAGCCACGAAGACCCTGAGGTCAAGTTCAACTGGTACGTG<br>GACGGCGTGGAGGTGCATAATGCCAAGACAAAGCCGCGGGAG<br>GAGCAGTACAACAGCACGTACCGTGTGGTCAGCGTCCTCACC<br>GTCCTGCACCAGGACTGGCTGAATGGCAAGGAGTACAAGTGC<br>AAGGTCTCCAACAAAGCCCTCGGAGCCCCCATCGAGAAAACC<br>ATCTCCAAAGCCAAAGGGCAGCCCCGAGAACCACAGGTGTAC<br>ACCCTGCCCCCATGCCGGGATGAGCTGACCAAGAACCAGGTC<br>AGCCTGTGGTGCCTGGTCAAAGGCTTCTATCCCAGCGACATC<br>GCCGTGGAGTGGGAGAGCAATGGGCAGCCGGAGAACAACTAC<br>AAGACCACGCCTCCCGTGCTGGACTCCGACGGCTCCTTCTTC<br>CTCTACAGCAAGCTCACCGTGGACAAGAGCAGGTGGCAGCAG<br>GGGAACGTCTTCTCATGCTCCGTGATGCATGAGGCTCTGCAC<br>AACCACTACACGCAGAAGAGCCTCTCCCTGTCTCCGGGTAAA<br>TCCGGAGGCCTGAACGACATCTTCGAGGCCCAGAAGATTGAA<br>TGGCACGAG |
| 189 | Polypeptide sequence cynomolgus CD19 antigen Fc knob chain avi tag | PQEPLVVKVEEGDNAVLQCLEGTSDGPTQQLVWCRDSPFEPF<br>LNLSLGLPGMGIRMGPLGIWLLIFNVSNQTGGFYLCQPGLPS<br>EKAWQPGWTVSVEGSGELFRWNVSDLGGLGCGLKNRSSEGPS<br>SPSGKLNSSQLYVWAKDRPEMWEGEPVCGPPRDSLNQSLSQD<br>LTMAPGSTLWLSCGVPPDSVSRGPLSWTHVRPKGPKSSLLSL<br>ELKDDRPDRDMWVVDTGLLLTRATAQDAGKYYCHRGNWTKSF<br>YLEITARPALWHWLLRIGGWKVDASGGSPTPPTPGGGSADKT<br>HTCPPCPAPEAAGGPSVFLFPPKPKDTLMISRTPEVTCVVVD<br>VSHEDPEVKFNWYVDGVEVHNAKTKPREEQYNSTYRVVSVLT<br>VLHQDWLNGKEYKCKVSNKALGAPIEKTISKAKGQPREPQVY<br>TLPPCRDELTKNQVSLWCLVKGFYPSDIAVEWESNGQPENNY<br>KTTPPVLDSDGSFFLYSKLTVDKSRWQQGNVFSCSVMHEALH<br>NHYTQKSLSLSPGKSGGLNDIFEAQKIEWHE |

For the production of the monomeric antigen/Fc fusion molecules, exponentially growing suspension CHO cells were co-transfected with two plasmids encoding the two components of fusion protein (knob and hole chains) using standard methods.

Secreted protein was purified from cell culture supernatant by affinity chromatography using Protein A, followed by size exclusion chromatography. For affinity chromatography, the supernatant was loaded on a MABSELECT SURE® column volume (CV)=5-15 mL, resin from GE Healthcare) equilibrated with Sodium Phosphate (20 mM), Sodium Citrate (20 mM), 0.5M sodium chloride buffer (pH 7.5). Unbound protein was removed by washing with at least 6 column volumes of the same buffer. The bound protein was eluted using a linear gradient; step 1, 10 CV from 0 to 60% elution buffer (20 mM sodium citrate, 500 mM Sodium chloride buffer (pH 2.5)); step 2, 2 CV from 60 to 100% elution buffer. For the linear gradient an additional 2 column volumes step elution with 100% elution buffer was applied.

The pH of collected fractions was adjusted by adding 1/40 (v/v) of 2M Tris, pH8.0. The protein was concentrated and filtered prior to loading on a HILOAD® Superdex 200 column (GE Healthcare) equilibrated with 2 mM MOPS, 150 mM sodium chloride, 0.02% (w/v) sodium azide solution of pH 7.4.

Table 44 summarizes the yield and final monomer content of monomeric human and cynomolgus CD19 antigen Fc(kih) fusion protein.

TABLE 44

Biochemical analysis of monomeric human and cynomolgus CD19 antigen Fc(kih) fusion protein

| Construct | Monomer [%] (SEC) | Yield [mg/l] |
| --- | --- | --- |
| monomeric human CD19 Fc(kih) fusion protein | 91 | 0.2 |
| monomeric cynomolgus CD19 Fc(kih) fusion protein | 95 | 3.56 |

Part of the purified antigen was in vitro biotinylated using the BirA biotin-protein ligase standard reaction kit (Avidity, Cat. # BirA500) according to the manufacturer's instructions. The biotinylation degree for the human CD19-containing fusion was 94%, for the respective cynomolgus CD19 construct 100%. The biotinylated protein was then used for selection, screening and characterization of affinity-matured 8B8-derived clones devoid of the de-amidation hotspots N27d and N28.

7.1.2 Generation of Anti-CD19 Clone 8B8-018

7.1.2.1 Immunization and Generation of Mouse Anti-Human CD19 Antibodies (Hybridomas)

Balb/c mice were immunized six times and boosted with CD19-transfected HEK293 cells (mean receptor density 35,000 per cell). The immune response was monitored by testing serum samples with a CD19-cell-ELISA on human CD19-transfected NIH-3T3 cells. Spleen cells from mice with sufficient titers of anti-human CD19 antibody were used for immortalization by fusion with mouse myeloma cell line P3X63 Ag8.653. Three fusions were carried out and hybridoma supernatants screened by cell-ELISA on human CD19-transfected NIH-3T3 cells and FACS binding assay using Daudi (CD19+) and CD19-cells for anti-human CD19 specific antibodies (see Example 1 of WO 2011/147834).

7.1.2.2 Hybridoma Screening and Cell Biological Functional Evaluation of Anti-CD19 Antibody Cell-ELISA for screening antibodies against human CD19

A cell ELISA was applied for screening of hybridomas, and to identify those hybridomas that secrete antibodies against human-CD19. NIH3T3 cells transfected with human-CD19 were used as positive cells; non-transfected NIH3T3 cells were used as negative control cells. For the assessment of the positive hybridomas the OD ratio between transfected and non-transfected NIH3T3 cells was quantified.

Culture Medium: DMEM high glucose (4.5 mg/ml), 10% FCS, Na-Pyruvate, NEAA, Glutamine
    Antibodies positive control: anti CD19 monoclonal antibody (IgG1) Pharmingen Cat#555409 c=1 mg/ml
    Detection antibody: Goat anti-Mouse IgG (H+L) HRP Conjugate Bio-Rad Cat#170-06516
    Dilution 1: 2000 in 1×ELISA Blocking Reagent
    Other reagents: Fibronectin Roche Cat#838039 c=1 mg/ml
    Glutardialdehyde: 25% stock solution//Grade Agar Scientific #R102 final concentration: 0.05% in PBS
    ELISA Blocking Reagent: 10× stock solution//Roche Cat#1112589
    TMB substrate: Roche Cat#11432559
    Stop Solution: 1 M H2SO4
    BioRad Cat#170-6516 Dilution 1: 2000 in 1×ELISA Blocking Reagent Day 1:
    Fibronectin coating: 5 µg/cm$^2$ in PBS; 96 well plate=32 cm$^2$; 160 µg/plate in 6 ml
    PBS, 50 µl/well
    incubate 45 min at RT, aspirate coating solution
    Seed 1.25×104 cells/well in 50 µl culture medium in a 96 well plate
    incubate 40 hours at 37° C.
    add to upper half of the plate: NIH3T3 cells expressing CD19
    add to lower half of the plate: non-transfected NIH3T3 cells Day 3:
    Addition of positive control antibody or samples (supernatant or mouse serum) in 50 µl culture medium
    incubate for 2 h at 4° C.
    Remove medium, fix cells with 100 µl Glutardialdehyde (0.05% in PBS)
    Wash two times with 200 µl PBS
    Addition of detection antibody 1:2000, 50 µl/well
    incubate 2 h at RT
    wash three times with 200 µl PBS
    add 50 µl TMB, incubate for 30 min. at RT,
    stop by addition of 25 µl M H2SO4; read extinction at 450 nm/620 nm
    Calculation of results: ratio OD NIH3T3 CD19: OD NIH3T3 non-transfected The selected antibody demonstrated specific binding to CD19 transfected NIH3T3 cells as compared to untransfected NIH3T3 cells (see Example 2 of WO 2011/147834).

7.1.2.3 Humanization of Anti-CD19 Antibody

The CD19 binding specificity of the murine antibody was transferred onto a human acceptor framework to eliminate potential immunogenicity issues arising from sequence stretches that the human body will recognize as foreign. This was done by engrafting the entire complementary determining regions (CDR) of the murine (donor) antibody onto a human (acceptor) antibody framework, and is called CDR-grafting or antibody humanization.

The murine amino acid sequence was aligned with a collection of human germ-line antibody V genes, and sorted according to sequence identity and homology. Before selecting one particular acceptor sequence, the so-called canonical loop structures of the donor antibody have to be determined (Morea, V., et al., Methods, Vol 20, Issue 3 (2000) 267-279). These canonical loop structures are determined by the type of residues present at the so-called canonical positions. These positions lie (partially) outside of the CDR regions, and have to be kept functionally equivalent in the final construct in order to retain the CDR conformation of the parental (donor) antibody. The human germ-line sequence VBASE_VH1_1 was chosen as the acceptor for the heavy chain and sequence VBASE_VK2_5 was chosen for the light chain.

7.1.2.4 Removal of Deamidation Hotspots

It has been found that the wild-type humanized anti-human CD19 antibody has three deamidation hotspots in the HVR-L1: NSNGNT (SEQ ID NO: 190). Additionally it has been found that in the HVR-H2 a further deamidation hotspot is present: KFNG (SEQ ID NO: 191). To address the deamidation hotspot in the HVR-H2 an N (Asn) to Q (Gln) point mutation at position 64 (numbering according to Kabat) has been introduced. Thus, the antibody as reported herein has a HVR-H2 comprising the amino acid sequence TEKFQGRVTM (SEQ ID NO: 192).

To address the deamidation hotspots in the light chain and to obtain a humanized anti-human CD19 antibody with improved deamidation stability individual mutations at Kabat position 27d, 27e, 28 and 29 and a double mutation at positions 27e and 28 (numbering according to Kabat) were introduced. In total 9 variants (var.1 to var.9) of the wild-type humanized antibody (var.0) have been generated (see Table 45).

After storage for two weeks at pH 7.4 the amount of deamidated antibody is increased to approx. 18.5%. The variant antibody with an S27eP mutation (var.5) shows approx. 2% deamidation and 2% succinimide formation after purification. During storage at pH 7.4 for two weeks only approx. 7.5% deamidated antibody is present. Var. 5 is named clone 8B8-018 and was elected for the preparation of CD19-targeted TNF family ligand trimer-containing antigen binding molecules.

TABLE 45

Variants of humanized wild-type CD19 antibody

| Kabat position LC: | | 2222 7789 de | Kabat position HC: | 6 4 |
|---|---|---|---|---|
| var.0: | wt | QSLENSNGNTYLNW | | TEKFNGKATM |
| var.1: | N27dH | QSLEHSNGNTYLNW | | TEKFQGRVTM |
| var.2: | N27dQ | QSLEQSNGNTYLNW | | TEKFQGRVTM |
| var.3: | S27eA | QSLENANGNTYLNW | | TEKFQGRVTM |
| var.4: | S27eV | QSLENVNGNTYLNW | | TEKFQGRVTM |
| var.5: | S27eP | QSLENPNGNTYLNW | | TEKFQGRVTM |
| var.6: | N28Q | QSLENSQGNTYLNW | | TEKFQGRVTM |
| var.7: | G29A | QSLENSNANTYLNW | | TEKFQGRVTM |
| var.8: | G29V | QSLENSNVNTYLNW | | TEKFQGRVTM |
| var.9: | S27eP/N28S | QSLENPSGNTYLNW | | TEKFQGRVTM |

| parameter | variant | | | | | | | | | |
|---|---|---|---|---|---|---|---|---|---|---|
| | 0 | 1 | 2 | 3 | 4 | 5 | 6 | 7 | 8 | 9 |
| $K_D$ (BIACORE ®) [nM] | 5 | 250 | 136 | 2 | 1 | 6 | 54 | 4 | 16 | 45 |
| $t_{1/2}$ [min] | — | 0.1 | 1.1 | 105.2 | 191.5 | 43.6 | 4.4 | 51.5 | 17.6 | 4 |
| human CD19 binding after pH 7.4 incubation [%] | 46 | 0 | 75 | 84 | 85 | 95 | 91 | 72 | 83 | 83 |
| human CD19 binding after pH 6.0 incubation [%] | 90 | 0 | 95 | 95 | 97 | 99 | 97 | 86 | 91 | 87 |
| SEC main peak after incubation [%] | >95 | >95 | >95 | >95 | >95 | >95 | >95 | >95 | >95 | — |

It has been found that with a single mutation at position 27e according to Kabat from S (serine) to P (proline) all deamidation hotspots in the HVR-L1 can be addressed. This is a mutation not of the deamidation prone N (asparagine) residue but of a neighboring residue.

Thus, the antibody as reported herein has a HVR-L1 comprising the amino acid sequence LENPNGNT (SEQ ID NO: 193). In one embodiment the humanized anti-human CD19 antibody comprises a HVR-L1 that has the amino acid sequence LENPSGNT (SEQ ID NO: 194).

Additionally these antibodies maintain the cross-reactivity to cynomolgus CD19 as shown in the following Table 46.

| EC50 [µg/ml] | var.0 | var.5 | var.9 |
|---|---|---|---|
| huCD19 ECD | 0.087 | 0.084 | 0.089 |
| cyCD19 ECD | 0.313 | 0.255 | 0.435 |

The wild-type humanized anti-human CD19 antibody (var.0) shows after purification approx. 7.5% deamidation.

7.1.3 Preparation of Monovalent CD19(8B8-018) Targeted 4-1BB Ligand (71-254) Trimer-Containing Fc (kih) Fusion Antigen Binding Molecule with Crossed CH1-CL Domains with Charged Residues (Construct 3.1)

Figure 29A:
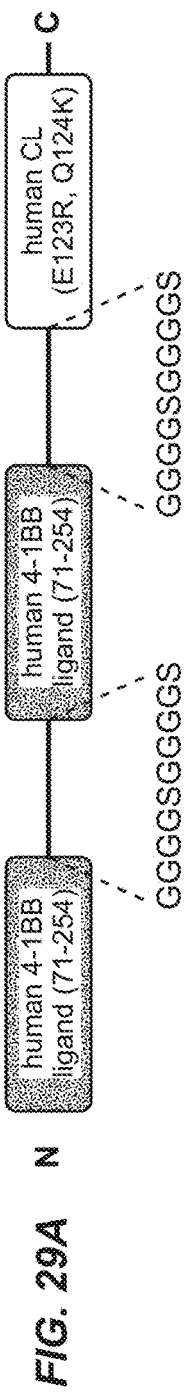
FIGS. 29A to 29D show components for the assembly of split trimeric human 4-1BB ligands including linker GGGGSGGGGS (SEQ ID NO:13).

A polypeptide containing two ectodomains of 4-1BB ligand (71-254), separated by $(G_4S)_2$ (SEQ ID NO:13) linkers, and fused to the human IgG1-CL domain, was cloned as depicted in FIG. 29A: human 4-1BB ligand, $(G_4S)_2$ (SEQ ID NO:13) connector, human 4-1BB ligand, $(G_4S)_2$ (SEQ ID NO:13) connector, human CL. A polypeptide containing one ectodomain of 4-1BB ligand (71-254) and fused to the human IgG1-CH domain, was cloned as described in FIG. 29B: human 4-1BB ligand, $(G_4S)_2$ (SEQ ID NO:13) connector, human CH.

The polypeptide encoding the dimeric 4-1BB ligand fused to human CL domain was subcloned in frame with the human IgG1 heavy chain CH2 and CH3 domains on the knob (Merchant, Zhu et al. 1998). To improve correct pairing the following mutations have been introduced in the crossed CH-CL. In the dimeric 4-1BB ligand fused to human CL, E123R and Q124K. In the monomeric 4-1BB ligand fused to human CH1, K147E and K213E.

The variable region of heavy and light chain DNA sequences encoding a binder specific for CD19, clone 8B8-018, were subcloned in frame with either the constant heavy chain of the hole or the constant light chain of human IgG1. The Pro329Gly, Leu234Ala and Leu235Ala mutations have been introduced in the constant region of the knob and hole heavy chains to abrogate binding to Fc gamma receptors according to the method described in WO 2012/130831.

Figure 30A:
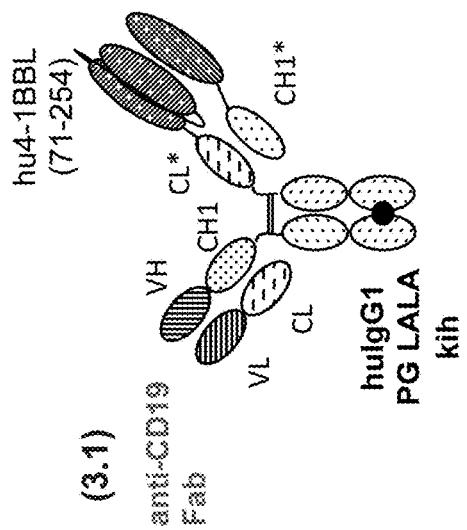
FIGS. 30A to 30F show the CD19-targeted 4-1BBL-trimer-containing antigen binding molecules Constructs 3.1 to 3.6 of the invention. The preparation and production of these constructs is described in Example 3. The VH and VL domains are those of anti-CD19 antibody 8B8-018, the thick black point stands for the knob-into-hole modification. * symbolizes amino acid modifications in the CH1 and CL domain (so-called charged residues).

Combination of the dimeric ligand-Fc knob chain containing the S354C/T366W mutations, the monomeric CH1 fusion, the targeted anti-CD19-Fc hole chain containing the Y349C/T366S/L368A/Y407V mutations and the anti-CD19 light chain allows generation of a heterodimer, which includes an assembled trimeric 4-1BB ligand and a CD19 binding Fab (FIG. 30A, Construct 3.1).

Table 47 shows the cDNA and amino acid sequences of the monovalent CD19(8B8-018) targeted split trimeric 4-1BB ligand (71-254) Fc (kih) fusion antigen binding molecule with crossed CH-CL and charged residues (construct 3.1).

TABLE 47 cDNA and amino acid sequences of monovalent CD19 (8B8-018) targeted split trimeric 4-1BB ligand (71-254) Fc (kih) fusion containing CH-CL cross with charged residues (construct 3.1). *for charged residues

| SEQ ID NO: | Description | Sequence |
|---|---|---|
| 129 | Nucleotide sequence Dimeric hu 4-1BBL (71-254)-CL* Fc knob chain | see Table 3 |
| 130 | Nucleotide sequence Monomeric hu 4-1BBL (71-254)-CH1* | see Table 3 |
| 203 | Nucleotide sequence anti-CD19(8B8-018) Fc hole chain | CAGGTCCAGCTGGTGCAGTCCGGCGCCGAGGTCAAGAA<br>ACCCGGGGCTTCTGTGAAGGTTTCATGCAAGGCAAGCG<br>GATACACCTTCACCGACTATATCATGCATTGGGTCAGGC<br>AGGCCCCTGGCCAAGGTCTCGAATGGATGGGCTACATTA<br>ACCCATATAATGATGGCTCCAAATACACCGAGAAGTTTC<br>AGGGAAGAGTCACTATGACATCTGACACCAGTATCAGC<br>ACTGCTTACATGGAGCTGTCCCGCCTTCGGTCTGATGAC<br>ACCGCAGTGTATTACTGTGCCAGGGGCACATATTACTAC<br>GGCTCAGCTCTGTTCGACTATTGGGGGCAGGGAACCACA<br>GTAACCGTGAGCTCCGCTAGCACCAAGGGCCCCTCCGTG<br>TTCCCCCTGGCCCCCAGCAGCAAGAGCACCAGCGGCGG<br>CACAGCCGCTCTGGGCTGCCTGGTCAAGGACTACTTCCC<br>CGAGCCCGTGACCGTGTCCTGGAACAGCGGGAGCCCTGA<br>CCTCCGGCGTGCACACCTTCCCCGCCGTGCTGCAGAGTT<br>CTGGCCTGTATAGCCTGAGCAGCGTGGTCACCGTGCCTT<br>CTAGCAGCCTGGGCACCCAGACCTACATCTGCAACGTG<br>AACCACAAGCCCAGCAACACCAAGGTGGACAAGAAGGT<br>GGAGCCCAAGAGCTGCGACAAAACTCACACATGCCCAC<br>CGTGCCCAGCACCTGAAGCTGCAGGGGGACCGTCAGTC<br>TTCCTCTTCCCCCCAAAACCCAAGGACACCCTCATGATC<br>TCCCGGACCCCTGAGGTCACATGCGTGGTGGTGGACGTG<br>AGCCACGAAGACCCTGAGGTCAAGTTCAACTGGTACGT<br>GGACGGCGTGGAGGTGCATAATGCCAAGACAAAGCCGC<br>GGGAGGAGCAGTACAACAGCACGTACCGTGTGGTCAGC<br>GTCCTCACCGTCCTGCACCAGGACTGGCTGAATGGCAAG<br>GAGTACAAGTGCAAGGTCTCCAACAAAGCCCTCGGCGC<br>CCCCATCGAGAAAACCATCTCCAAAGCCAAAGGGCAGC<br>CCCGAGAACCACAGGTGTGCACCCTGCCCCCATCCGG<br>GATGAGCTGACCAAGAACCAGGTCAGCCTCTCGTGCGC<br>AGTCAAAGGCTTCTATCCCAGCGACATCGCCGTGGAGTG<br>GGAGAGCAATGGGCAGCCGGAGAACAACTACAAGACC<br>ACGCCTCCCGTGCTGGACTCCGACGGCTCCTTCTTCCTC<br>GTGAGCAAGCTCACCGTGGACAAGAGCAGGTGGCAGCA<br>GGGGAACGTCTTCTCATGCTCCGTGATGCATGAGGCTCT<br>GCACAACCACTACACGCAGAAGAGCCTCTCCCTGTCTCC<br>GGGTAAA |
| 204 | Nucleotide sequence anti-CD19(8B8-018) light chain | GACATCGTCATGACCCAGACACCCCTGTCCCTCTCTGTG<br>ACCCCTGGCCAGCCAGCCTCAATTAGCTGCAAGTCCTCT<br>CAAAGTCTGGAGAACCCCAATGGGAACACTTACTTAAT<br>TGGTATCTGCAGAAACCCGGACAATCCCCTCAACTCCTG<br>ATCTACAGGGTCTCTAAGAGATTCTCAGGCGTGCCAGAT<br>CGCTTTAGCGGTTCCGGGTCTGGCACAGACTTCACCTTG<br>AAGATTAGTCGGGTTGAAGCTGAGGATGTGGGAGTCTA<br>TTACTGTCTGCAGCTCACTCATGTGCCCTACACCTTTGGT<br>CAGGGCACAAAACTGGAGATCAAGCGGACCGTGGCCGC<br>TCCCTCCGTGTTCATCTTCCCACCCTCCGACGAGCAGCT |

TABLE 47-continued cDNA and amino acid sequences of monovalent CD19 (8B8-018) targeted split trimeric 4-1BB ligand (71-254) Fc (kih) fusion containing CH-CL cross with charged residues (construct 3.1). *for charged residues

| SEQ ID NO: | Description | Sequence |
|---|---|---|
| | | GAAGTCCGGCACCGCCAGCGTGGTGTGCCTGCTGAACA ACTTCTACCCCCGCGAGGCCAAGGTGCAGTGGAAGGTG GACAACGCCCTGCAGTCCGGCAACTCCCAGGAATCCGT GACCGAGCAGGACTCCAAGGACAGCACCTACTCCCTGT CCTCCACCCTGACCCTGTCCAAGGCCGACTACGAGAAGC ACAAGGTGTACGCCTGCGAAGTGACCCACCAGGGCCTG TCCAGCCCCGTGACCAAGTCCTTCAACCGGGGCGAGTGC |
| 115 | Dimeric hu 4-1BBL (71-254)-CL* Fc knob chain | see Table 3 |
| 116 | Monomeric hu 4-1BBL (71-254)-CH1* | see Table 3 |
| 205 | anti-CD19(8B8-018) Fc hole chain | QVQLVQSGAEVKKPGASVKVSCKASGYTFTDYIMHWVRQ APGQGLEWMGYINPYNDGSKYTEKFQGRVTMTSDTSISTA YMELSRLRSDDTAVYYCARGTYYYGSALFDYWGQGTTVT VSSASTKGPSVFPLAPSSKSTSGGTAALGCLVKDYFPEPVT VSWNSGALTSGVHTFPAVLQSSGLYSLSSVVTVPSSSLGTQ TYICNVNHKPSNTKVDKKVEPKSCDKTHTCPPCPAPEAAG GPSVFLFPPKPKDTLMISRTPEVTCVVVDVSHEDPEVKFNW YVDGVEVHNAKTKPREEQYNSTYRVVSVLTVLHQDWLN GKEYKCKV SNKALGAPIEKTISKAKGQPREPQVCTLPPSRD ELTKNQVSLSCAVKGFYPSDIAVEWESNGQPENNYKTTPP VLDSDGSFFLVSKLTVDKSRWQQGNVFSCSVMHEALHNH YTQKSLSLSPGK |
| 206 | anti-CD19(8B8-018) light chain | DIVMTQTPLSLSVTPGQPASISCKSSQSLENPNGNTYLNWY LQKPGQSPQLLIYRVSKRFSGVPDRFSGSGSGTDFTLKISRV EAEDVGVYYCLQLTHVPYTFGQGTKLEIKRTVAAPSVFIFP PSDEQLKSGTASVVCLLNNFYPREAKVQWKVDNALQSGN SQESVTEQDSKDSTYSLSSTLTLSKADYEKHKVYACEVTH QGLSSPVTKSFNRGEC |

7.1.4 Preparation of Monovalent CD19(8B8-018) Targeted 4-1BB Ligand (71-254) Trimer-Containing Fc (kih) Fusion Antigen Binding Molecule with Crossed CH1-CL Domains without Charged Residues (Construct 3.2)

Figure 29B:
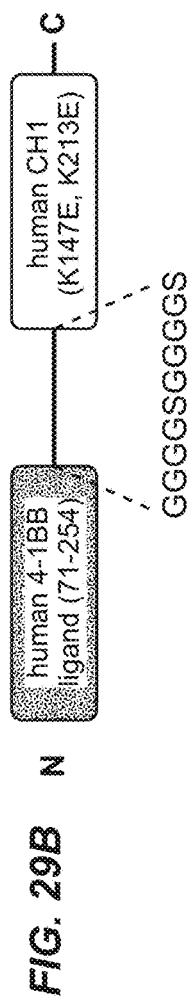

A polypeptide containing two ectodomains of 4-1BB ligand (71-254), separated by $(G_4S)_2$ (SEQ ID NO:13) linkers, and fused to the human IgG1-CL domain, was cloned in analogy as depicted in FIG. 29A), but without amino acid mutations in the CL domain: human 4-1BB ligand, $(G_4S)_2$ (SEQ ID NO:13) connector, human 4-1BB ligand, $(G_4S)_2$ (SEQ ID NO:13) connector, human CL. A polypeptide containing one ectodomain of 4-1BB ligand (71-254) and fused to the human IgG1-CH1 domain, was cloned in analogy as depicted in FIG. 29B), but without amino acid mutations in the CH1 domain: human 4-1BB ligand, $(G_4S)_2$ (SEQ ID NO:13) connector, human CH1.

The variable region of heavy and light chain DNA sequences encoding a binder specific for CD19, clone 8B8-018, were subcloned in frame with either the constant heavy chain of the hole or the constant light chain of human IgG1.

Figure 30B:
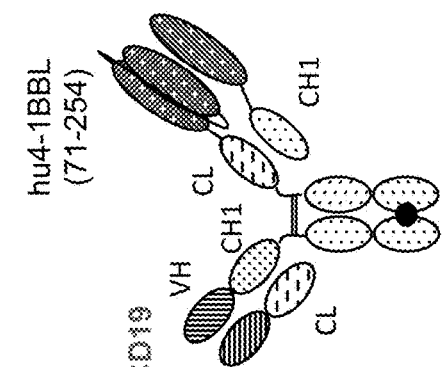

The Pro329Gly, Leu234Ala and Leu235Ala mutations have been introduced in the constant region of the knob and hole heavy chains to abrogate binding to Fc gamma receptors according to the method described in WO 2012/130831. Combination of the dimeric ligand-Fc knob chain containing the S354C/T366W mutations, the monomeric CH1 fusion, the targeted anti-CD19-Fc hole chain containing the Y349C/T366S/L368A/Y407V mutations and the anti-CD19 light chain allows generation of a heterodimer, which includes an assembled trimeric 4-1BB ligand and a CD19-binding Fab (FIG. 30B, Construct 3.2).

Table 48 shows the cDNA and amino acid sequences of the monovalent CD19(8B8-018) targeted split trimeric 4-1BB ligand (71-254) Fc (kih) fusion antigen binding molecule containing crossed CH-CL cross without charged residues (construct 3.2).

TABLE 48 cDNA and amino acid sequences of monovalent CD19(8B8-018) targeted split trimeric 4-1BB ligand (71-254) Fc (kih) fusion containing CH—CL cross without charged residues (construct 3.2).

| SEQ ID NO: | Description | Sequence |
|---|---|---|
| 165 | Nucleotide sequence dimeric ligand (71-254) - CL Fc knob chain | see Table 22 |
| 166 | Nucleotide sequence monomeric hu 4-1BBL (71-254) - CH1 | see Table 22 |

TABLE 48-continued cDNA and amino acid sequences of monovalent CD19(8B8-018) targeted split trimeric 4-1BB ligand (71-254) Fc (kih) fusion containing CH—CL cross without charged residues (construct 3.2).

| SEQ ID NO: | Description | Sequence |
|---|---|---|
| 203 | Nucleotide sequence anti-CD19(8B8-018) Fc hole chain | see Table 47 |
| 204 | Nucleotide sequence anti-CD19(8B8-018) light chain | see Table 47 |
| 117 | Dimeric ligand (71-254) - CL Fc knob chain | see Table 22 |
| 118 | Monomeric ligand (71-254) - CH1 | see Table 22 |
| 205 | anti-CD19(8B8-018) Fc hole chain | see Table 47 |
| 206 | anti-CD19(8B8-018) light chain | see Table 47 |

7.1.5 Preparation of Bivalent CD19(8B8-018) Targeted 4-1BB Ligand (71-254) Trimer-Containing Fc (kih) Fusion Antigen Binding (Construct 3.3)

Figure 29C:
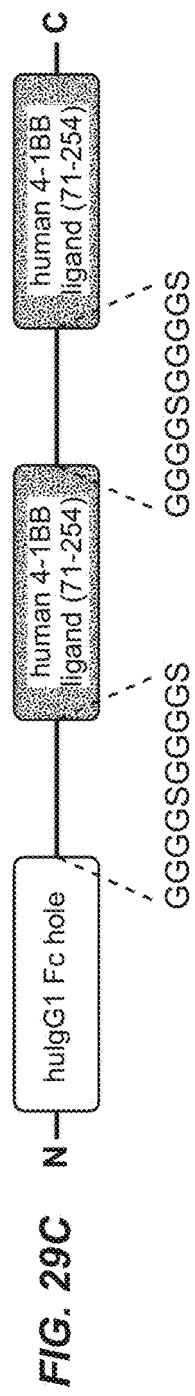
Figure 29D:
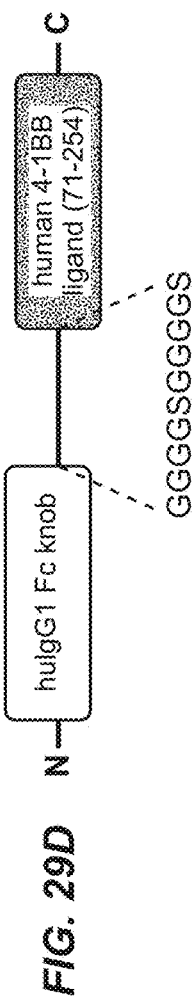

A polypeptide containing two ectodomains of 4-1BB ligand (71-254), separated by (G$_4$S)$_2$ (SEQ ID NO:13) linkers was fused to the C-terminus of human IgG1 Fc hole chain, as depicted in FIG. 29C: human IgG1 Fc hole, (G$_4$S)$_2$ (SEQ ID NO:13) connector, human 4-1BB ligand, (G$_4$S)$_2$ (SEQ ID NO:13) connector, human 4-1BB ligand. A polypeptide containing one ectodomain of 4-1BB ligand (71-254) and fused to the C-terminus of human IgG1 Fc knob chain as described in FIG. 29D: human IgG1 Fc knob, (G$_4$S)$_2$ (SEQ ID NO:13) connector, human 4-1BB ligand.

Figure 30C:
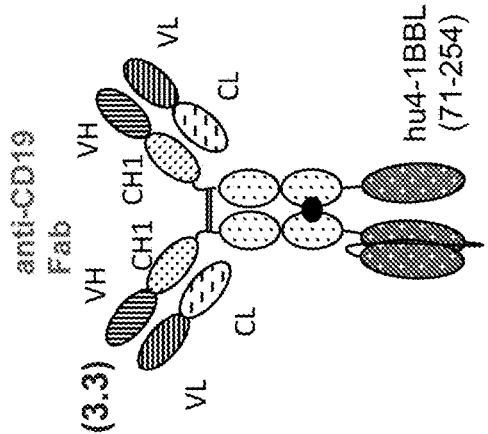

The variable region of heavy and light chain DNA sequences encoding a binder specific for CD19, clone 8B8-018, were subcloned in frame with either the constant heavy chain of the hole, the knob or the constant light chain of human IgG1. The Pro329Gly, Leu234Ala and Leu235Ala mutations have been introduced in the constant region of the knob and hole heavy chains to abrogate binding to Fc gamma receptors according to the method described in WO 2012/130831. Combination of the anti-CD19 huIgG1 hole dimeric ligand chain containing the Y349C/T366S/L368A/Y407V mutations, the anti-CD19 huIgG1 knob monomeric ligand chain containing the S354C/T366W mutations and the anti-CD19 light chain allows generation of a heterodimer, which includes an assembled trimeric 4-1BB ligand and two CD19 binding Fabs (FIG. 30C, construct 3.3).

Table 49 shows the cDNA and amino acid sequences of the bivalent CD19(8B8-018) targeted split trimeric 4-1BB ligand (71-254) Fc (kih) fusion antigen binding molecule (construct 3.3).

TABLE 49

Base pair sequences of bivalent CD19(8B8-018) targeted split trimeric 4-1BB ligand Fc (kih) PGLALA fusion (construct 3.3)

| SEQ ID NO: | Description | Sequence |
|---|---|---|
| 207 | Nucleotide sequence anti-CD19(8B8-018) Fc hole dimeric ligand chain | CAGGTCCAGCTGGTGCAGTCCGGCGCCGAGGTCAAGAA<br>ACCCGGGGCTTCTGTGAAGGTTTCATGCAAGGCAAGCG<br>GATACACCTTCACCGACTATATCATGCATTGGGTCAGGC<br>AGGCCCCTGGCCAAGGTCTCGAATGGATGGGCTACATTA<br>ACCCATATAATGATGGCTCCAAATACACCGAGAAGTTTC<br>AGGGGAAGAGTCACTATGACATCTGACACCAGTATCAGC<br>ACTGCTTACATGGAGCTGTCCCGCCTTCGGTCTGATGAC<br>ACCGCAGTGTATTACTGTGCCAGGGGCACATATTACTAC<br>GGCTCAGCTCTGTTCGACTATTGGGGCAGGGAACCACA<br>GTAACCGTGAGCTCCGCTAGCACCAAGGGCCCCTCCGTG<br>TTCCCCCTGGCCCCCAGCAGCAAGAGCACCAGCGGCGG<br>CACAGCCGCTCTGGGCTGCCTGGTCAAGGACTACTTCCC<br>CGAGCCCGTGACCGTGTCCTGGAACAGCGGAGCCCTGA<br>CCTCCGGCGTGCACACCTTCCCCGCCGTGCTGCAGAGTT<br>CTGGCCTGTATAGCCTGAGCAGCGTGGTCACCGTGCCTT<br>CTAGCAGCCTGGGCACCCAGACCTACATCTGCAACGTG<br>AACCACAAGCCCAGCAACACCAAGGTGGACAAGAAGGT<br>GGAGCCCAAGAGCTGCGACAAAACTCACACATGCCCAC<br>CGTGCCCAGCACCTGAAGCTGCAGGGGGACCGTCAGTC<br>TTCCTCTTCCCCCCAAAACCCAAGGACACCCTCATGATC<br>TCCCGGACCCCTGAGGTCACATGCGTGGTGGTGGACGTG<br>AGCCACGAAGACCCTGAGGTCAAGTTCAACTGGTACGT<br>GGACGGCGTGGAGGTGCATAATGCCAAGACAAAGCCGC<br>GGGAGGAGCAGTACAACAGCACGTACCGTGTGGTCAGC<br>GTCCTCACCGTCCTGCACCAGGACTGGCTGAATGGCAAG<br>GAGTACAAGTGCAAGGTCTCCAACAAAGCCCTCGGCGC<br>CCCCATCGAGAAAACCATCTCCAAAGCCAAAGGGCAGC<br>CCCGAGAACCACAGGTGTGCACCCTGCCCCCATCCCGG<br>GATGAGCTGACCAAGAACCAGGTCAGCCTCTCGTGCGC<br>AGTCAAAGGCTTCTATCCCAGCGACATCGCCGTGGAGTG<br>GGAGAGCAATGGGCAGCCGGAGAACAACTACAAGACC<br>ACGCCTCCCGTGCTGGACTCCGACGGCTCCTTCTTCCTC<br>GTGAGCAAGCTCACCGTGGACAAGAGCAGGTGGCAGCA<br>GGGGAACGTCTTCTCATGCTCCGTGATGCATGAGGCTCT<br>GCACAACCACTACACGCAGAAGAGCCTCTCCCTGTCTCC |

TABLE 49-continued

Base pair sequences of bivalent CD19(8B8-018) targeted split trimeric 4-1BB ligand Fc (kih) PGLALA fusion (construct 3.3)

| SEQ ID NO: | Description | Sequence |
|---|---|---|
| | | GGGTGGAGGCGGCGGAAGCGGAGGAGGAGGATCCAGA GAGGGCCCTGAGCTGAGCCCCGATGATCCTGCTGGACT GCTGGACCTGCGGCAGGGCATGTTTGCTCAGCTGGTGGC CCAGAACGTGCTGCTGATCGATGGCCCCTGTCCTGGTA CAGCGATCCTGGACTGGCTGGCGTGTCACTGACAGGCG GCCTGAGCTACAAAGAGGACACCAAAGAACTGGTGGTG GCCAAGGCCGGCGTGTACTACGTGTTCTTTCAGCTGGAA CTGCGGAGAGTGGTGGCCGGCGAAGGATCTGGCTCTGT GTCTCTGGCCCTGCATCTGCAGCCTCTGAGAAGCGCTGC TGGCGCTGCAGCTCTGGCACTGACAGTGGATCTGCCTCC TGCCAGCTCCGAGGCCCGGAATAGCGCATTTGGGTTTCA AGGCAGGCTGCTGCACCTGTCTGCCGGCCAGAGGCTGG GAGTGCATCTGCACACAGAGGCCAGGGCTAGACACGCC TGGCAGCTGACACAGGGCGCTACAGTGCTGGGCCTGTTC AGAGTGACCCCCGAGATTCCAGCCGGCCTGCCTTCTCCA AGAAGCGAAGGCGGAGGCGGATCTGGCGGCGGAGGATC TAGAGAGGGACCCGAACTGTCCCTGACGATCCAGCCG GGCTGCTGGATCTGAGACAGGGAATGTTCGCCCAGCTG GTGGCTCAGAATGTGCTGCTGATTGACGGACCTCTGAGC TGGTACTCCGACCCAGGGCTGGCAGGGGTGTCCCTGACT GGGGGACTGTCCTACAAAGAAGATACAAAAGAACTGGT GGTGGCTAAAGCTGGGGTGTACTATGTGTTTTTTCAGCT GGAACTGAGGCGGGTGGTGGCTGGGGAGGGCTCAGGAT CTGTGTCCCTGGCTCTGCATCTGCAGCCACTGCGCTCTG CTGCTGGCGCAGCTGCACTGGCTCTGACTGTGGACCTGC CACCAGCCTCTAGCGAGGCCAGAAACAGCGCCTTCGGG TTCCAAGGACGCCTGCTGCATCTGAGCGCCGGACAGCG CCTGGGAGTGCATCTGCATACTGAAGCCAGAGCCCGGC ATGCTTGGCAGCTGACTCAGGGGCAACTGTGCTGGGA CTGTTTCGCGTGACACCTGAGATCCCTGCCGGACTGCCA AGCCCTAGATCAGAA |
| 208 | Nucleotide sequence anti-CD19(8B8-018) Fc knob monomeric ligand | CAGGTCCAGCTGGTGCAGTCCGGCGCCGAGGTCAAGAA ACCCGGGGCTTCTGTGAAGGTTTCATGCAAGGCAAGCG GATACACCTTCACCGACTATATCATGCATTGGGTCAGGC AGGCCCCTGGCCAAGGTCTCGAATGGATGGGCTACATTA ACCCATATAATGATGGCTCCAAATACACCGAGAAGTTTC AGGGAAGAGTCACTATGACATCTGACACCAGTATCAGC ACTGCTTACATGGAGCTGTCCCGCCTTCGGTCTGATGAC ACCGCAGTGTATTACTGTGCCAGGGGCACATATTACTAC GGCTCAGCTCTGTTCGACTATTGGGGGCAGGGAACCACA GTAACCGTGAGCTCCGCTAGCACCAAGGGCCCATCGGT CTTCCCCCTGGCACCCTCCTCCAAGAGCACCTCTGGGGG CACAGCGGCCCTGGGCTGCCTGGTCAAGGACTACTTCCC CGAACCGGTGACGGTGTCGTGGAACTCAGGCGCCCTGA CCAGCGGCGTGCACACCTTCCCGGCTGTCCTACAGTCCT CAGGACTCTACTCCCTCAGCAGCGTGGTGACCGTGCCCT CCAGCAGCTTGGGCACCCAGACCTACATCTGCAACGTG AATCACAAGCCCAGCAACACCAAGGTGGACAAGAAAGT TGAGCCCAAATCTTGTGACAAAACTCACACATGCCCACC GTGCCCAGCACCTGAAGCTGCAGGGGGACCGTCAGTCT TCCTCTTCCCCCCAAAACCCAAGGACACCCTCATGATCT CCCGGACCCCTGAGGTCACATGCGTGGTGGTGGACGTG AGCCACGAAGACCCTGAGGTCAAGTTCAACTGGTACGT GGACGGCGTGGAGGTGCATAATGCCAAGACAAAGCCGC GGGAGGAGCAGTACAACAGCACGTACCGTGTGGTCAGC GTCCTCACCGTCCTGCACCAGGACTGGCTGAATGGCAAG GAGTACAAGTGCAAGGTCTCCAACAAAGCCCTCGGCGC CCCCATCGAGAAAACCATCTCCAAAGCCAAAGGGCAGC CCCGAGAACCACAGGTGTACACCCTGCCCCCCTGCAGA GATGAGCTGACCAAGAACCAGGTGTCCCTGTGGTGTCTG GTCAAGGGCTTCTACCCCAGCGATATCGCCGTGGAGTGG GAGAGCAACGGCCAGCCTGAGAACAACTACAAGACCAC CCCCCCTGTGCTGGACAGCGACGGCAGCTTCTTCCTGTA CTCCAAACTGACCGTGGACAAGAGCCGGTGGCAGCAGG GCAACGTGTTCAGCTGCAGCGTGATGCACGAGGCCCTG CACAACCACTACACCCAGAAGTCCCTGAGCCTGAGCCC CGGCGGAGGCGGCGGAAGCGGAGGAGGAGGATCCAGA GAGGGCCCTGAGCTGAGCCCCGATGATCCTGCTGGACT GCTGGACCTGCGGCAGGGCATGTTTGCTCAGCTGGTGGC CCAGAACGTGCTGCTGATCGATGGCCCCTGTCCTGGTA CAGCGATCCTGGACTGGCTGGCGTGTCACTGACAGGCG GCCTGAGCTACAAAGAGGACACCAAAGAACTGGTGGTG GCCAAGGCCGGCGTGTACTACGTGTTCTTTCAGCTGGAA |

TABLE 49-continued

Base pair sequences of bivalent CD19(8B8-018) targeted split trimeric 4-1BB ligand Fc (kih) PGLALA fusion (construct 3.3)

| SEQ ID NO: | Description | Sequence |
|---|---|---|
|  |  | CTGCGGAGAGTGGTGGCCGGCGAAGGATCTGGCTCTGT<br>GTCTCTGGCCCTGCATCTGCAGCCTCTGAGAAGCGCTGC<br>TGGCGCTGCAGCTCTGGCACTGACAGTGGATCTGCCTCC<br>TGCCAGCTCCGAGGCCCGGAATAGCGCATTTGGGTTTCA<br>AGGCAGGCTGCTGCACCTGTCTGCCGGCCAGAGGCTGG<br>GAGTGCATCTGCACACAGAGGCCAGGGCTAGACACGCC<br>TGGCAGCTGACACAGGGCGCTACAGTGCTGGGCCTGTTC<br>AGAGTGACCCCCGAGATTCCAGCCGGCCTGCCTTCTCCA<br>AGAAGCGAA |
| 204 | Nucleotide sequence anti-CD19(8B8-018) light chain | see Table 47 |
| 209 | anti-CD19(8B8-018) Fc hole dimeric ligand chain | QVQLVQSGAEVKKPGASVKVSCKASGYTFTDYIMHWVRQ<br>APGQGLEWMGYINPYNDGSKYTEKFQGRVTMTSDTSISTA<br>YMELSRLRSDDTAVYYCARGTYYYGSALFDYWGQGTTVT<br>VSSASTKGPSVFPLAPSSKSTSGGTAALGCLVKDYFPEPVT<br>VSWNSGALTSGVHTFPAVLQSSGLYSLSSVVTVPSSSLGTQ<br>TYICNVNHKPSNTKVDKKVEPKSCDKTHTCPPCPAPEAAG<br>GPSVFLFPPKPKDTLMISRTPEVTCVVVDVSHEDPEVKFNW<br>YVDGVEVHNAKTKPREEQYNSTYRVVSVLTVLHQDWLN<br>GKEYKCKVSNKALGAPIEKTISKAKGQPREPQVCTLPPSRD<br>ELTKNQVSLSCAVKGFYPSDIAVEWESNGQPENNYKTTPP<br>VLDSDGSFFLVSKLTVDKSRWQQGNVFSCSVMHEALHNH<br>YTQKSLSLSPGGGGSGGGGSREGPELSPDDPAGLLDLRQ<br>GMFAQLVAQNVLLIDGPLSWYSDPGLAGVSLTGGLSYKED<br>TKELVVAKAGVYYVFFQLELRRVVAGEGSGSVSLALHLQP<br>LRSAAGAAALALTVDLPPASSEARNSAFGFQGRLLHLSAG<br>QRLGVHLHTEARARHAWQLTQGATVLGLFRVTPEIPAGLP<br>SPRSEGGGGSGGGGSREGPELSPDDPAGLLDLRQGMFAQL<br>VAQNVLLIDGPLSWYSDPGLAGVSLTGGLSYKEDTKELVV<br>AKAGVYYVFFQLELRRVVAGEGSGSVSLALHLQPLRSAAG<br>AAALALTVDLPPASSEARNSAFGFQGRLLHLSAGQRLGVH<br>LHTEARARHAWQLTQGATVLGLFRVTPEIPAGLPSPRSE |
| 210 | anti-CD19(8B8-018) Fc knob monomeric ligand | QVQLVQSGAEVKKPGASVKVSCKASGYTFTDYIMHWVRQ<br>APGQGLEWMGYINPYNDGSKYTEKFQGRVTMTSDTSISTA<br>YMELSRLRSDDTAVYYCARGTYYYGSALFDYWGQGTTVT<br>VSSASTKGPSVFPLAPSSKSTSGGTAALGCLVKDYFPEPVT<br>VSWNSGALTSGVHTFPAVLQSSGLYSLSSVVTVPSSSLGTQ<br>TYICNVNHKPSNTKVDKKVEPKSCDKTHTCPPCPAPEAAG<br>GPSVFLFPPKPKDTLMISRTPEVTCVVVDVSHEDPEVKFNW<br>YVDGVEVHNAKTKPREEQYNSTYRVVSVLTVLHQDWLN<br>GKEYKCKVSNKALGAPIEKTISKAKGQPREPQVYTLPPCRD<br>ELTKNQVSLWCLVKGFYPSDIAVEWESNGQPENNYKTTPP<br>VLDSDGSFFLYSKLTVDKSRWQQGNVFSCSVMHEALHNH<br>YTQKSLSLSPGGGGSGGGGSREGPELSPDDPAGLLDLRQ<br>GMFAQLVAQNVLLIDGPLSWYSDPGLAGVSLTGGLSYKED<br>TKELVVAKAGVYYVFFQLELRRVVAGEGSGSVSLALHLQP<br>LRSAAGAAALALTVDLPPASSEARNSAFGFQGRLLHLSAG<br>QRLGVHLHTEARARHAWQLTQGATVLGLFRVTPEIPAGLP<br>SPRSE |
| 206 | anti-CD19(8B8-018) light chain | see Table 47 |

7.1.6 Preparation of Monovalent CD19 (8B8-018) Targeted 4-1BB Ligand (71-248) Trimer-Containing Fc (kih) Fusion Antigen Binding Molecule with Crossed CH1-CL Domains with Charged Residues (Construct 3.4)

A polypeptide containing two ectodomains of 4-1BB ligand (71-248), separated by $(G_4S)_2$ (SEQ ID NO:13) linkers, and fused to the human IgG1-CL domain, was cloned in analogy to the one depicted in FIG. 29A: human 4-1BB ligand, $(G_4S)_2$ (SEQ ID NO:13) connector, human 4-1BB ligand, $(G_4S)_2$ (SEQ ID NO:13) connector, human CL. A polypeptide containing one ectodomain of 4-1BB ligand (71-248) and fused to the human IgG1-CH domain, was cloned in nalogy to the one described in FIG. 29B: human 4-1BB ligand, $(G_4S)_2$ (SEQ ID NO:13) connector, human CH.

The polypeptide encoding the dimeric 4-1BB ligand fused to human CL domain was subcloned in frame with the human IgG1 heavy chain CH2 and CH3 domains on the knob (Merchant, Zhu et al. 1998). To improve correct pairing the following mutations have been introduced in the crossed CH-CL. In the dimeric 4-1BB ligand fused to human CL, E123R and Q124K. In the monomeric 4-1BB ligand fused to human CH1, K147E and K213E.

The variable region of heavy and light chain DNA sequences encoding a binder specific for CD19, clone 8B8-

Figure 30D:
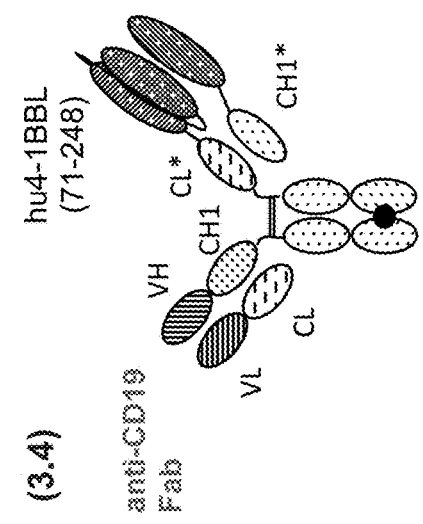

018, were subcloned in frame with either the constant heavy chain of the hole or the constant light chain of human IgG1. The Pro329Gly, Leu234Ala and Leu235Ala mutations have been introduced in the constant region of the knob and hole heavy chains to abrogate binding to Fc gamma receptors according to the method described in WO 2012/130831. Combination of the dimeric ligand-Fc knob chain containing the S354C/T366W mutations, the monomeric CH1 fusion, the targeted anti-CD19-Fc hole chain containing the Y349C/T366S/L368A/Y407V mutations and the anti-CD19 light chain allows generation of a heterodimer, which includes an assembled trimeric 4-1BB ligand and a CD19 binding Fab (FIG. 30D, construct 3.4).

Table 50 shows the cDNA and amino acid sequences of the monovalent CD19(8B8-018) targeted split trimeric 4-1BB ligand (71-248) Fc (kih) fusion antigen binding molecule with crossed CH-CL and charged residues (construct 3.4).

TABLE 50 cDNA and amino acid sequences of monovalent CD19(8B8-018) targeted split trimeric 4-1BB ligand (71-248) Fc (kih) fusion containing CH—CL cross with charged residues (construct 3.4).

| SEQ ID NO: | Description | Sequence |
|---|---|---|
| 169 | Nucleotide sequence dimeric ligand (71-248) - CL* Fc knob chain | see Table 24 |
| 170 | Nucleotide sequence monomeric hu 4-1BBL (71-248) - CH1* | see Table 24 |
| 203 | Nucleotide sequence anti-CD19(8B8-018) Fc hole chain | see Table 47 |
| 204 | Nucleotide sequence anti-CD19(8B8-018) light chain | see Table 47 |
| 119 | Dimeric ligand (71-248) - CL* Fc knob chain | see Table 24 |
| 120 | Monomeric ligand (71-248) - CH1* | see Table 24 |
| 205 | anti-CD19(8B8-018) Fc hole chain | see Table 47 |
| 206 | anti-CD19(8B8-018) light chain | see Table 47 |

*charged residues 7.1.7 Preparation of Monovalent CD19(8B8-018) Targeted 4-1BB Ligand (71-248) Trimer-Containing Fc (kih) Fusion Antigen Binding Molecule with Crossed CH1-CL Domains without Charged Residues (Construct 3.5)

A polypeptide containing two ectodomains of 4-1BB ligand (71-248), separated by $(G_4S)_2$ (SEQ ID NO:13) linkers, and fused to the human IgG1-CL domain, was cloned in analogy as depicted in FIG. 29A), but without amino acid mutations in the CL domain: human 4-1BB ligand, $(G_4S)_2$ (SEQ ID NO:13) connector, human 4-1BB ligand, $(G_4S)_2$ (SEQ ID NO:13) connector, human CL. A polypeptide containing one ectodomain of 4-1BB ligand (71-248) and fused to the human IgG1-CH1 domain, was cloned in analogy as depicted in FIG. 29B), but without amino acid mutations in the CH1 domain: human 4-1BB ligand, $(G_4S)_2$ (SEQ ID NO:13) connector, human CH1.

Figure 30E:
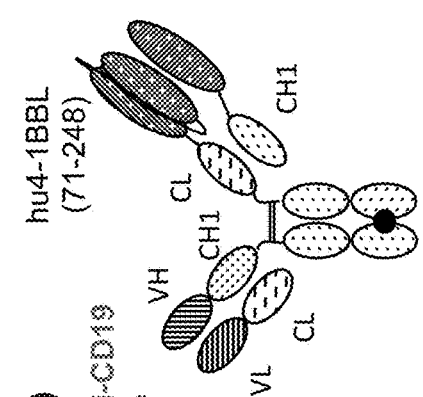

The variable region of heavy and light chain DNA sequences encoding a binder specific for CD19, clone 8B8-018, were subcloned in frame with either the constant heavy chain of the hole or the constant light chain of human IgG1. The Pro329Gly, Leu234Ala and Leu235Ala mutations have been introduced in the constant region of the knob and hole heavy chains to abrogate binding to Fc gamma receptors according to the method described in WO 2012/130831. Combination of the dimeric ligand-Fc knob chain containing the S354C/T366W mutations, the monomeric CH1 fusion, the targeted anti-CD19-Fc hole chain containing the Y349C/T366S/L368A/Y407V mutations and the anti-CD19 light chain allows generation of a heterodimer, which includes an assembled trimeric 4-1BB ligand and a CD19-binding Fab (FIG. 30E, Construct 3.5).

Table 51 shows the cDNA and amino acid sequences of the monovalent CD19(8B8-018) targeted split trimeric 4-1BB ligand (71-248) Fc (kih) fusion antigen binding molecule containing crossed CH-CL cross without charged residues (construct 3.5).

TABLE 51 cDNA and amino acid sequences of monovalent CD19(8B8-018) targeted split trimeric 4-1BB ligand (71-248) Fc (kih) fusion containing CH—CL cross without charged residues (construct 3.5).

| SEQ ID NO: | Description | Sequence |
|---|---|---|
| 171 | Nucleotide sequence dimeric ligand (71-248) - CL Fc knob chain | see Table 25 |
| 172 | Nucleotide sequence monomeric ligand (71-248) - CH1 | see Table 25 |
| 203 | Nucleotide sequence anti-CD19(8B8-018) Fc hole chain | see Table 47 |
| 204 | Nucleotide sequence anti-CD19(8B8-018) light chain | see Table 47 |
| 173 | Dimeric ligand (71-248) - CL Fc knob chain | see Table 25 |
| 174 | Monomeric ligand (71-248) - CH1 | see Table 25 |
| 205 | anti-CD19(8B8-018) Fc hole chain | see Table 47 |
| 206 | anti-CD19(8B8-018) light chain | see Table 47 |

7.1.8 Preparation of Bivalent CD19(8B8-018) Targeted 4-1BB Ligand (71-248) Trimer-Containing Fc (kih) Fusion Antigen Binding (Construct 3.6)

A polypeptide containing two ectodomains of 4-1BB ligand (71-248), separated by $(G_4S)_2$ (SEQ ID NO:13) linkers was fused to the C-terminus of human IgG1 Fc hole chain, as depicted in FIG. 29C: human IgG1 Fc hole, $(G_4S)_2$ (SEQ ID NO:13) connector, human 4-1BB ligand, $(G_4S)_2$ (SEQ ID NO:13) connector, human 4-1BB ligand. A polypeptide containing one ectodomain of 4-1BB ligand (71-254) and fused to the C-terminus of human IgG1 Fc knob chain as described in FIG. 29D: human IgG1 Fc knob, $(G_4S)_2$ (SEQ ID NO:13) connector, human 4-1BB ligand. The variable region of heavy and light chain DNA sequences encoding a binder specific for CD19, clone 8B8-

Figure 30F:
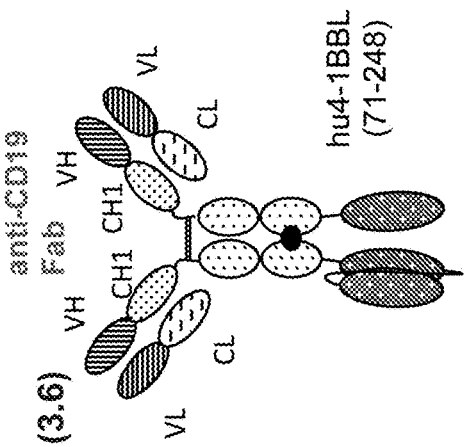

018, were subcloned in frame with either the constant heavy chain of the hole, the knob or the constant light chain of human IgG1. The Pro329Gly, Leu234Ala and Leu235Ala mutations have been introduced in the constant region of the knob and hole heavy chains to abrogate binding to Fc gamma receptors according to the method described in WO 2012/130831. Combination of the anti-CD19 huIgG1 hole dimeric ligand chain containing the Y349C/T366S/L368A/Y407V mutations, the anti-CD19 huIgG1 knob monomeric ligand chain containing the S354C/T366W mutations and the anti-CD19 light chain allows generation of a heterodimer, which includes an assembled trimeric 4-1BB ligand and two CD19 binding Fabs (FIG. 30F, construct 3.6).

Table 52 shows the cDNA and amino acid sequences of the bivalent CD19(8B8-018) targeted split trimeric 4-1BB ligand (71-248) Fc (kih) fusion antigen binding molecule (construct 3.6).

TABLE 52 cDNA and amino acid sequences of bivalent CD19 (8B8-018) targeted split trimeric 4-1BB ligand (71-248) Fc (kih) fusion (construct 3.6)

| SEQ ID NO: | Description | Sequence |
|---|---|---|
| 211 | Nucleotide sequence anti-CD19 (8B8-018) Fc hole dimeric ligand (71-248) chain | CAGGTCCAGCTGGTGCAGTCCGGCGCCGAGGTCAAGAA ACCCGGGGCTTCTGTGAAGGTTTCATGCAAGGCAAGCG GATACACCTTCACCGACTATATCATGCATTGGGTCAGGC AGGCCCCTGGCCAAGGTCTCGAATGGATGGGCTACATTA ACCCATATAATGATGGCTCCAAATACACCGAGAAGTTTC AGGGAAGAGTCACTATGACATCTGACACCAGTATCAGC ACTGCTTACATGGAGCTGTCCCGCCTTCGGTCTGATGAC ACCGCAGTGTATTACTGTGCCAGGGGCACATATTACTAC GGCTCAGCTCTGTTCGACTATTGGGGCAGGGAACCACA GTAACCGTGAGCTCCGCTAGCACCAAGGGCCCCTCCGTG TTCCCCCTGGCCCCCAGCAGCAAGAGCACCAGCGGCGG CACAGCCGCTCTGGGCTGCCTGGTCAAGGACTACTTCCC CGAGCCCGTGACCGTGTCCTGGAACAGCGGAGCCCTGA CCTCCGGCGTGCACACCTTCCCCGCCGTGCTGCAGAGTT CTGGCCTGTATAGCCTGAGCAGCGTGGTCACCGTGCCTT CTAGCAGCCTGGGCACCCAGACCTACATCTGCAACGTG AACCACAAGCCCAGCAACACCAAGGTGGACAAGAAGGT GGAGCCCAAGAGCTGCGACAAAACTCACACATGCCCAC CGTGCCCAGCACCTGAAGCTGCAGGGGGACCGTCAGTC TTCCTCTTCCCCCCAAAACCCAAGGACACCCTCATGATC TCCCGGACCCCTGAGGTCACATGCGTGGTGGTGGACGTG AGCCACGAAGACCCTGAGGTCAAGTTCAACTGGTACGT GGACGGCGTGGAGGTGCATAATGCCAAGACAAAGCCGC GGGAGGAGCAGTACAACAGCACGTACCGTGTGGTCAGC GTCCTCACCGTCCTGCACCAGGACTGGCTGAATGGCAAG GAGTACAAGTGCAAGGTCTCCAACAAAGCCCTCGGCGC CCCCATCGAGAAAACCATCTCCAAAGCCAAAGGGCAGC CCCGAGAACCACAGGTGTGCACCCTGCCCCCATCCCGG GATGAGCTGACCAAGAACCAGGTCAGCCTCTCGTGCGC AGTCAAAGGCTTCTATCCCAGCGACATCGCCGTGGAGTG GGAGAGCAATGGGCAGCCGGAGAACAACTACAAGACC ACGCCTCCCGTGCTGGACTCCGACGGCTCCTTCTTCCTC GTGAGCAAGCTCACCGTGGACAAGAGCAGGTGGCAGCA GGGGAACGTCTTCTCATGCTCCGTGATGCATGAGGCTCT GCACAACCACTACACGCAGAAGAGCCTCTCCCTGTCTCC GGGTGGAGGCGGCGGAAGCGGAGGAGGAGGATCCAGA GAGGGCCCTGAGCTGAGCCCTGATGATCCTGCCGGACT GCTGGACCTGCGGCAGGGAATGTTTGCCCAGCTGGTGGC CCAGAACGTGCTGCTGATCGATGGCCCCCTGTCCTGGTA CAGCGATCCTGGACTGGCTGGCGTGTCACTGACAGGCG GCCTGAGCTACAAAGAGGACACCAAAGAACTGGTGGTG GCCAAGGCCGGCGTGTACTACGTGTTCTTTCAGCTGGAA CTGCGGAGAGTGGTGGCCGGCGAAGGATCTGGCTCTGT GTCTCTGGCCCTGCATCTGCAGCCTCTGAGATCTGCTGC TGGCGCCGCTGCTCTGGCACTGACAGTGGATCTGCCTCC TGCCAGCAGCGAGGCCCGGAATAGCGCATTTGGGTTCA AGGCAGGCTGCTGCACCTGTCTGCCGGCCAGAGGCTGG GAGTGCATCTGCACACAGAGGCCAGGGCTAGACACGCC TGGCAGCTGACACAGGGCGCTACAGTGCTGGGCCTGTTC AGAGTGACCCCCGAGATTCCAGCAGGCCTGGGAGGCGG CGGATCTGGCGGCGGAGGATCTAGAGAAGGACCCGAGC TGTCCCCCGACGATCCCGCTGGGCTGCTGGATCTGAGAC AGGGCATGTTCGCTCAGCTGGTGGCTCAGAATGTGCTGC TGATTGACGGACCTCTGAGCTGGTACTCCGACCCAGGGC TGGCAGGGGTGTCCCTGACTGGGGGACTGTCCTACAAA GAAGATACAAAAGAACTGGTGGTGGCTAAAGCTGGGGT GTACTATGTGTTTTTTCAGCTGGAACTGAGGCGGGTGGT GGCTGGGGAGGGCTCAGGATCTGTGTCCCTGGCTCTGCA TCTGCAGCCACTGCGCTCTGCAGCAGGGGCTGCAGCACT GGCCCTGACTGTGGACCTGCCCCCAGCTTCTTCCGAGGC CAGAAACAGCGCCTTCGGGTTCCAAGGACGCCTGCTGC ATCTGAGCGCCGGACAGCGCCTGGGAGTGCATCTGCAT ACTGAAGCCAGAGCCCGGCATGCTTGGCAGCTGACTCA |

TABLE 52-continued cDNA and amino acid sequences of bivalent CD19 (8B8-018) targeted split trimeric 4-1BB ligand (71-248) Fc (kih) fusion (construct 3.6)

| SEQ ID NO: | Description | Sequence |
|---|---|---|
| | | GGGGGCAACTGTGCTGGGACTGTTTCGCGTGACACCTGA<br>GATCCCAGCCGGGCTC |
| 212 | Nucleotide sequence anti-CD19 (8B8-018) Fc knob monomeric (71-248) ligand | CAGGTCCAGCTGGTGCAGTCCGGCGCCGAGGTCAAGAA<br>ACCCGGGGCTTCTGTGAAGGTTTCATGCAAGGCAAGCG<br>GATACACCTTCACCGACTATATCATGCATTGGGTCAGGC<br>AGGCCCCTGGCCAAGGTCTCGAATGGATGGGCTACATTA<br>ACCCATATAATGATGGCTCCAAATACACCGAGAAGTTTC<br>AGGGAAGAGTCACTATGACATCTGACACCAGTATCAGC<br>ACTGCTTACATGGAGCTGTCCCGCCTTCGGTCTGATGAC<br>ACCGCAGTGTATTACTGTGCCAGGGGCACATATTACTAC<br>GGCTCAGCTCTGTTCGACTATTGGGGGCAGGGAACCACA<br>GTAACCGTGAGCTCCGCTAGCACCAAGGGCCCATCGGT<br>CTTCCCCCTGGCACCCTCCTCCAAGAGCACCTCTGGGGG<br>CACAGCGGCCCTGGGCTGCCTGGTCAAGGACTACTTCC<br>CGAACCGGTGACGGTGTCGTGGAACTCAGGCGCCCTGA<br>CCAGCGGCGTGCACACCTTCCCGGCTGTCCTACAGTCCT<br>CAGGACTCTACTCCCTCAGCAGCGTGGTGACCGTGCCCT<br>CCAGCAGCTTGGGCACCCAGACCTACATCTGCAACGTG<br>AATCACAAGCCCAGCAACACCAAGGTGGACAAGAAAGT<br>TGAGCCCAAATCTTGTGACAAAACTCACACATGCCCACC<br>GTGCCCAGCACCTGAAGCTGCAGGGGGACCGTCAGTCT<br>TCCTCTTCCCCCCAAAACCCAAGGACACCCTCATGATCT<br>CCCGGACCCCTGAGGTCACATGCGTGGTGGTGGACGTG<br>AGCCACGAAGACCCTGAGGTCAAGTTCAACTGGTACGT<br>GGACGGCGTGGAGGTGCATAATGCCAAGACAAAGCCGC<br>GGGAGGAGCAGTACAACAGCACGTACCGTGTGGTCAGC<br>GTCCTCACCGTCCTGCACCAGGACTGGCTGAATGGCAAG<br>GAGTACAAGTGCAAGGTCTCCAACAAAGCCCTCGGCGC<br>CCCCATCGAGAAAACCATCTCCAAAGCCAAAGGGCAGC<br>CCCGAGAACCACAGGTGTACACCCTGCCCCCCTGCAGA<br>GATGAGCTGACCAAGAACCAGGTGTCCCTGTGGTGTCTG<br>GTCAAGGGCTTCTACCCCAGCGATATCGCCGTGGAGTGG<br>GAGAGCAACGGCCAGCCTGAGAACAACTACAAGACCAC<br>CCCCCCTGTGCTGGACAGCGACGGCAGCTTCTTCCTGTA<br>CTCCAAACTGACCGTGGACAAGAGCCGGTGGCAGCAGG<br>GCAACGTGTTCAGCTGCAGCGTGATGCACGAGGCCCTG<br>CACAACCACTACACCCAGAAGTCCCTGAGCCTGAGCCC<br>CGGCGGAGGCGGCGGAAGCGGAGGAGGAGGATCCAGA<br>GAGGGCCCTGAGCTGAGCCCTGATGATCCTGCCGGACT<br>GCTGGACCTGCGCCAGGGAATGTTTGCCCAGCTGGTGGC<br>CCAGAACGTGCTGCTGATCGATGGCCCCCTGTCCTGGTA<br>CAGCGATCCTGGACTGGCTGGCGTGTCACTGACAGGCG<br>GCCTGAGCTACAAAGAGGACACCAAAGAACTGGTGGTG<br>GCCAAGGCCGGCGTGTACTACGTGTTCTTTCAGCTGGAA<br>CTGCGGAGAGTGGTGGCCGGCGAAGGATCTGGCTCTGT<br>GTCTCTGGCCCTGCATCTGCAGCCTCTGAGATCTGCTGC<br>TGGCGCCGCTGCTCTGGCACTGACAGTGGATCTGCCTCC<br>TGCCAGCAGCGAGGCCCGGAATAGCGCATTTGGGTTTCA<br>AGGCAGGCTGCTGCACCTGTCTGCCGGCCAGAGGCTGG<br>GAGTGCATCTGCACACAGAGGCCAGGGCTAGACACGCC<br>TGGCAGCTGACACAGGGCGCTACAGTGCTGGGCCTGTTC<br>AGAGTGACCCCCGAGATTCCTGCCGGGCTC |
| 204 | Nucleotide sequence anti-CD19 (8B8-018) light chain | see Table 47 |
| 213 | anti-CD19(8B8-018) Fc hole dimeric ligand (71-248) chain | QVQLVQSGAEVKKPGASVKVSCKASGYTFTDYIMHWVRQ<br>APGQGLEWMGYINPYNDGSKYTEKFQGRVTMTSDTSISTA<br>YMELSRLRSDDTAVYYCARGTYYYGSALFDYWGQGTTVT<br>VSSASTKGPSVFPLAPSSKSTSGGTAALGCLVKDYFPEPVT<br>VSWNSGALTSGVHTFPAVLQSSGLYSLSSVVTVPSSSLGTQ<br>TYICNVNHKPSNTKVDKKVEPKSCDKTHTCPPCPAPEAAG<br>GPSVFLFPPKPKDTLMISRTPEVTCVVVDVSHEDPEVKFNW<br>YVDGVEVHNAKTKPREEQYNSTYRVVSVLTVLHQDWLN<br>GKEYKCKVSNKALGAPIEKTISKAKGQPREPQVCTLPPSRD<br>ELTKNQVSLSCAVKGFYPSDIAVEWESNGQPENNYKTTPP<br>VLDSDGSFFLVSKLTVDKSRWQQGNVFSCSVMHEALHNH<br>YTQKSLSLSPGGGGSGGGGSREGPELSPDDPAGLLDLRQ<br>GMFAQLVAQNVLLIDGPLSWYSDPGLAGVSLTGGLSYKED<br>TKELVVAKAGVYYVFFQLELRRVVAGEGSGSVSLALHLQP<br>LRSAAGAAALALTVDLPPASSEARNSAFGFQGRLLHLSAG<br>QRLGVHLHTEARARHAWQLTQGATVLGLFRVTPEIPAGLG |

TABLE 52-continued cDNA and amino acid sequences of bivalent CD19 (8B8-018) targeted split trimeric 4-1BB ligand (71-248) Fc (kih) fusion (construct 3.6)

| SEQ ID NO: | Description | Sequence |
|---|---|---|
| | | GGGSGGGGSREGPELSPDDPAGLLDLRQGMFAQLVAQNV<br>LLIDGPLSWYSDPGLAGVSLTGGLSYKEDTKELVVAKAGV<br>YYVFFQLELRRVVAGEGSGSVSLALHLQPLRSAAGAAALA<br>LTVDLPPASSEARNSAFGFQGRLLHLSAGQRLGVHLHTEA<br>RARHAWQLTQGATVLGLFRVTPEIPAGL |
| 214 | anti-CD19<br>(8B8-018) Fc knob<br>monomeric (71-248)<br>ligand | QVQLVQSGAEVKKPGASVKVSCKASGYTFTDYIMHWVRQ<br>APGQGLEWMGYINPYNDGSKYTEKFQGRVTMTSDTSISTA<br>YMELSRLRSDDTAVYYCARGTYYYGSALFDYWGQGTTVT<br>VSSASTKGPSVFPLAPSSKSTSGGTAALGCLVKDYFPEPVT<br>VSWNSGALTSGVHTFPAVLQSSGLYSLSSVVTVPSSSLGTQ<br>TYICNVNHKPSNTKVDKKVEPKSCDKTHTCPPCPAPEAAG<br>GPSVFLFPPKPKDTLMISRTPEVTCVVVDVSHEDPEVKFNW<br>YVDGVEVHNAKTKPREEQYNSTYRVVSVLTVLHQDWLN<br>GKEYKCKVSNKALGAPIEKTISKAKGQPREPQVYTLPPCRD<br>ELTKNQVSLWCLVKGFYPSDIAVEWESNGQPENNYKTTPP<br>VLDSDGSFFLYSKLTVDKSRWQQGNVFSCSVMHEALHNH<br>YTQKSLSLSPGGGGGSGGGGSREGPELSPDDPAGLLDLRQ<br>GMFAQLVAQNVLLIDGPLSWYSDPGLAGVSLTGGLSYKED<br>TKELVVAKAGVYYVFFQLELRRVVAGEGSGSVSLALHLQP<br>LRSAAGAAALALTVDLPPASSEARNSAFGFQGRLLHLSAG<br>QRLGVHLHTEARARHAWQLTQGATVLGLFRVTPEIPAGL |
| 206 | anti-CD19<br>(8B8-018) light chain | see Table 47 |

7.2 Preparation of CD19 (8B8-Derived Affinity Matured) Targeted 4-1BB Ligand Trimer-Containing Fc Fusion Antigen Binding Molecules and Corresponding Control Molecules 7.2.1 Generation of 8B8-Derived Affinity-Matured Anti-CD19 Binders Devoid of Hotspots 7.2.1.1 Selection of Affinity Matured CD19-Specific Antibodies De-amidation of the asparagine residues at positions 27d and 28, located in CDR1 of the light chain of the humanized clone 8B8, leads to a significant reduction in the biological activity. Therefore, 2 phage display libraries were generated in which a) both asparagine residues at positions 27d and 28 were eliminated and b) additional CDRs of heavy and light chain were randomized in order to select for 8B8 variants with an improved affinity.

7.2.1.2 Generation of 8B8 Affinity Maturation Libraries Devoid of LCDR1 Hotspots Generation of affinity-matured 8B8-derived antibodies without the de-amidation sites N27d and N28, located in LCDR1, was carried out by phage display using standard protocols (Silacci et al, 2005). In a first step, the VL and VH DNA sequences of the humanized parental clone 8B8 (SEQ ID NO: 215 and SEQ ID NO: 216) were cloned into our phagemid which was then used as a template for randomization. In a next step, two libraries were generated for the selection of favourable clones by phage display. In order to eliminate the above-mentioned hotspot positions, a LCDR1 randomization primer (SEQ ID NO: 217) that only allowed amino acids S T Q E at positions 27d and 28 was used for both libraries. Maturation library 1 was randomized in CDR1 and 2 of both the light and the heavy chain, while maturation library 2 was randomized in CDR1 and 3 of the light chain and in CDR3 of the heavy chain. The randomized positions in the respective CDR regions are shown in FIGS. 31A-1 to 31A-2. For the generation of the maturation library 1, randomized in CDR1 and 2 of both the light and the heavy chain, three fragments were assembled by "splicing by overlapping extension" (SOE) PCR and cloned into the phage vector (FIGS. 31B-1 to 31B-2). The following primer combinations were used to generate the library fragments: fragment 1 (LMB3 (SEQ ID NO: 222) and CD19 L1 reverse random (SEQ ID NO: 217), fragment 2 (CD19 L2 forward random (SEQ ID NO: 218) and CD19 H1 reverse random (SEQ ID NO: 219), and fragment 3 (CD19 H2 forward random (SEQ ID NO: 220) and CD19 H3 reverse constant (SEQ ID NO: 221) (Table 53). After assembly of sufficient amounts of full length randomized fragment, it was digested with NcoI/NheI alongside with identically treated acceptor phagemid vector. A 3-fold molar excess of library insert was ligated with 10 µg of phagemid vector. Purified ligations were used for 20 transformations resulting in 2×10 exp9 transformants. Phagemid particles displaying the 8B8 affinity maturation library were rescued and purified by PEG/NaCl purification to be used for selections.

The generation of the second library, randomized in CDR1 and 3 of the light chain and in CDR3 of the heavy chain, was done similarly. The following primer combinations were used to generate the library fragments: fragment 1 (LMB3 (SEQ ID NO: 222) and CD19 L1 reverse random (SEQ ID NO: 217), fragment 2 (CD19 L1 forward constant (SEQ ID NO 223) and CD19 L3 reverse random (SEQ ID NO 224), and fragment 3 (CD19 L3 forward constant (SEQ ID NO: 225) and CD19 H3 reverse random (SEQ ID NO: 226) (Table 54). After assembly of sufficient amounts of full length randomized fragment, it was digested with NcoI/KpnI alongside with identically treated acceptor phagemid vector. A 3-fold molar excess of library insert was ligated with 20 ug of phagemid vector. Purified ligations were used for 40 transformations resulting in 2×10 exp9 transformants. Phagemid particles displaying the 8B8 affinity maturation library were rescued and purified by PEG/NaCl purification to be used for selections.

TABLE 53

Primers for 8B8 affinity maturation and hotspot removal library L1_L2/H1_H2

| SEQ ID | Name | Sequence |
|---|---|---|
| 217 | CD19 L1 reverse random | CAG CTG CGG GCT CTG ACC CGG TTT CTG GAG ATA CCA GTT CAG 1 CGT 2 GCC 3 GGA 4 TTC CAG AGA TTG GCT GGA TTT GCA AGA AAT G<br>1: 40% Y, 6% A/S/T/G/P/D/N/E/Q/V, 2: 40% N, 6% A/S/T/Y/G/P/D/E/Q/V, 3: 25% S/T/Q/E, 4: 25% S/T/Q/E |
| 218 | CD19 L2 forward random | CTC CAG AAA CCG GGT CAG AGC CCG CAG CTG CTG ATC TAC 5 GTA TCT 6 CGC 7 8 GGC GTT 9 GAT CGT TTC AGC GGT TCT GGA TCC GGC ACC<br>5: 30% R, 20% E, 5% A/S/T/Y/G/P/D/N/Q/V. 6: 30% K, 20% S, 5% A/N/T/Y/G/P/D/E/Q/V, 7: 40% F, 5% A/S/T/Y/G/P/D/E/Q/V/I/L, 8: 40% S, 6.6% A/T/Y/G/P/D/E/Q/V, 9: 50% P, 50% L |
| 219 | CD19 H1 reverse random | CAT CCA CTC CAG ACC CTG GCC CGG GGC CTG ACG AAC CCA 10 CAT 11 12 13 14 GAA 15 GTA ACC AGA TGC TTT GCA GCT CAC TTT AAC GGA AGC<br>10: 52% H, 4% G/A/S/P/T/N/Y/D/E/Q/V/I, 11: 30% I, 15% Y, 5% G/A/S/T/P/N/H/D/E/Q/V, 12: 52% Y, 4% G/A/S/P/T/N/H/D/E/Q/V/I, 13: 30% D, 15% G, 5% A/S/P/Y/N/H/D/E/Q/V/I, 14: 52% T, 4% G/A/S/P/Y/N/H/D/E/Q/V/I, 15: 52% T, 4% G/A/S/P/Y/N/H/D/E/Q/V/I |
| 220 | CD19 H2 forward random | CAG GCC CCG GGC CAG GGT CTG GAG TGG ATG GGC 16 ATT 17 CCA 18 19 20 21 TCC 22 TAT ACC 23 AAA TTC CAG GGC CGC GTC ACG ATG ACC<br>16: 45% Y, 5% A/S/P/T/N/H/D/E/Q/V/I, 17: 52% N, 4% G/A/S/P/Y/T/H/D/E/Q/V/I, 18: 40% Y, 5% G/A/S/P/N/T/H/D/E/Q/V/I, 19: 30% N, 15% S, 5% G/A/T/P/Y/H/D/E/Q/V/I, 20: 30% D, 15% G, 5% A/S/T/P/Y/N/H/D/E/Q/V/I, 21: 52% G, 4% N/A/S/P/Y/T/H/D/E/Q/V/I, 22: 30% K, 15% N, 4% G/A/S/P/Y/T/H/D/E/Q/V/I, 23: 30% E, 15% Q, 5% G/A/S/T/P/Y/N/H/D/V/I |
| 221 | CD19 H3 reverse constant | CGTCACCGGTTCGGGGAAGTAGTCCTTGACCAG |
| 222 | LMB3 | CAGGAAACAGCTATGACCATGATTAC |

TABLE 54

Primers for 8B8 affinity maturation and hotspot removal library L1_L3/H3

| SEQ ID | Name | Sequence |
|---|---|---|
| 223 | CD19 L1 forward constant | TGGTATCTCCAGAAACCGGGTCAGAGCCCGCAG |
| 217 | CD19 L1 reverse random | See Table 53 |
| 224 | CD19 L3 reverse random | TTT AAT TTC AGT TTA GTT CCT TGA CCG AAG GT 24 25 26 27 28 29 CTG CAG ACA ATA GTA GAC GCC AAC GTC TTC AGC<br>24: 52% Y, 4% G/A/S/T/N/P/D/E/Q/V/L/I, 25: 52% P, 4% G/A/S/T/Y/N/H/D/E/Q/V/I, 26: 42% V, 10% L, 4% G/A/S/T/Y/N/P/D/E/Q/V/I, 27: 52% H, 4% G/A/S/T/Y/N/P/D/E/Q/V/I, 28: 42% T, 10% I, 4% G/A/S/T/Y/N/P/D/E/Q/V/L, 29: 45% L, 11% G 4% A/S/T/Y/N/P/D/E/Q/V/I |
| 225 | CD19 L3 forward constant | ACCTTCGGTCAAGGAACTAAACTGGAAATTAAACG |

TABLE 54-continued

Primers for 8B8 affinity maturation and hotspot removal library L1_L3/H3

| SEQ ID | Name | Sequence |
|---|---|---|
| 226 | CD19 H3 reverse random | TT GGT GCT AGC AGA GCT TAC GGT CAC CGT GGT ACC TTG GCC CCA GTA ATC AAA 30 31 32 33 34 35 36 37 38 GCG TGC ACA ATA GTA AAC AGC GGT GTC<br>30: 50% L, 3.8% G/A/S/T/P/H/Y/N/D/E/Q/V/I, 31: 50% A, 4.2% G/S/T/P/H/Y/N/D/E/Q/V/I, 32: 50% S, 4.2% G/A/T/P/H/Y/N/D/E/Q/V/I, 33: 50% G 4.2% S/A/T/P/H/Y/N/D/E/Q/V/I, 34: 50% Y, 4.2% G/A/T/P/H/S/N/D/E/Q/V/I, 35: 50% Y, 4.2% G/A/T/P/H/S/N/D/E/Q/V/I, 36: 50% Y, 4.2% G/A/T/P/H/S/N/D/E/Q/V/I, 37: 50% T, 4.2% G/A/Y/P/H/S/N/D/E/Q/V/I, 38: 50% G 4.2% Y/A/T/P/H/S/N/D/E/Q/V/I |
| 222 | LMB3 | See Table 53 |

7.2.1.3 Selection of Affinity Matured 8B8-Derived Clones Devoid of LCDR1 Hotspots N27d and N28

For the selection of affinity-matured clones devoid of the LCDR1 hotspots N27d and N28, two selection approaches by phage display were performed:

In the first approach, the selection was executed on human CD19-Fc fusion protein using both phage display libraries. Panning rounds were performed in solution according to the following pattern: 1. binding of ~$10^{12}$ phagemid particles to 30 nM biotinylated CD19-Fc protein for 0.5 h in a total volume of 1 ml, 2. capture of biotinylated CD19-Fc protein and specifically bound phage particles by addition of 5.4×$10^7$ streptavidin-coated magnetic beads for 10 min, 3. washing of beads using 5×1 ml PBS/TWEEN® 20 (polysorbate 20) and 5×1 ml PBS, 4. elution of phage particles by addition of 1 ml 100 mM TEA for 10 min and neutralization by adding 500 ul M Tris/HCl pH 7.4, 5. re-infection of exponentially growing E. coli TG1 bacteria, and 6. infection with helperphage VCSM13 and subsequent PEG/NaCl precipitation of phagemid particles to be used in subsequent selection rounds. Selections were carried out over 3 rounds using decreasing antigen concentrations (30×$10^{-9}$M, 10×$10^{-9}$M, and 3×$10^{-9}$M). In round 2 and 3, capture of antigen:phage complexes was performed using neutravidin plates instead of streptavidin beads. Neutravidin plates were washed with 5×PBS/TWEEN® 20 (polysorbate 20) and 5×PBS. In round 3, the neutravidin plate was incubated overnight in 2 liters PBS for an "off-rate" selection before phage was eluted from the plate. Furthermore, cynomolgus CD19-Fc protein was used in round 2 in order to enrich cross-reactive binders.

In the second selection approach, the phage panning was executed on cells transiently expressing either the human or cynomolgus CD19 ECD on the cell surface. For the transient transfection of HEK cells, expression plasmids were generated that harbor the DNA sequences (from 5' to 3') for the following protein segments: A Flag tag, a SNAP tag, the CD19 ECD of either human or cynomolgus origin, and the transmembrane region of the Platelet-derived growth factor receptor (PDGFR) (SEQ ID NOs: 227 and 228). The expression of the respective proteins (SEQ ID NOs: 229 and 230) on the cell surface was confirmed by flow cytometry using an anti-Flag antibody for detection. Both libraries were exposed in the first selection round to cells either expressing the human or cynomolgus CD19 ECD-containing protein fusion. For the subsequent panning rounds, the species of the CD19 ECD was alternated accordingly. Cells transiently transfected with an irrelevant membrane protein were used for pre-clearing.

Panning rounds were performed according to the following pattern:

1. Transfection of HEK cells with constructs expressing either CD19 ECD or an irrelevant transmembrane protein according to the standard procedure described before,
2. Incubation of the cells for total 48h at 37° C. in an incubator with a 5% $CO_2$ atmosphere, 3. Isolation of cells by centrifugation (3 min at 250×g) and re-suspension of 1×10E7 CD19 ECD-positive cells and 1×10E7 negative cells in PBS/5% BSA, respectively,
3. Pre-clearing of unspecific phage by incubating the phage library with 1×107 CD19-negative cells for 60 min at 4° C. using a gently rotating tube rotator,
4. Centrifugation of cells at 250×g for 3 min and transfer of supernatant into a fresh tube and addition of 1×10E7 CD19-positive cells and incubation for 60 min at 4° C. by gentle rotation on a tube rotator,
5. Washing of cells by centrifugation for 1 min at 250×g, aspiration of the supernatant, and re-suspension in 1 ml PBS (8 times),
6. Phage elution with 1 ml 100 mM TEA, incubation for 5 min at RT, and neutralization of the eluate with 500 ul 1M Tris-HCl, pH7.6,
7. re-infection of exponentially growing E. coli TG1 bacteria, and
8. infection with helperphage VCSM13 and subsequent PEG/NaCl precipitation of phagemid particles to be used in subsequent selection rounds. Selections were carried out over 3 rounds.

For both selection approaches, specific binders were identified by ELISA as follows: 100 ul of 30 nM biotinylated CD19-Fc protein per well were coated on neutravidin plates. Fab-containing bacterial supernatants were added and binding Fabs were detected via their Flag-tags using an anti-Flag/HRP secondary antibody.

Clones that were ELISA-positive on recombinant human CD19 were further tested in a cell-based ELISA using cells that were transiently transfected with the human CD19 ECD-containing expression plasmid (SEQ ID NO: 227). This analysis was performed as follows: 48 h after transfection, HEK cells were harvested and centrifuged at 250×g for 5 min. Cells were then re suspended in ice-cold PBS BSA 2% to 4×$10^6$ cells/ml and incubated for 20 min on ice to block unspecific binding sites. 4×$10^5$ cells in 100 ul were distributed to each well of a 96 well plate and centrifuged at 250×g and 4° C. for 3 min. Supernatant was aspirated off and 50 ul bacterial supernatant containing soluble Fab fragments was diluted with 50 ul ice-cold PBS/BSA 2%, added to the plate, mixed with the cells and incubated for 1 h at 4° C. Afterwards, cells were washed 3 times with ice cold PBS before 100 ul PBS BSA 2% per well containing a 1:2000 dilution of anti-Fab-HRP antibody were added. After an incubation time of 1 h, cells were washed again 3 times with ice-cold PBS. For the development, 100 ul "1-step ultra TMB-ELISA" substrate was added per well. After an incubation time of 10 minutes, supernatant was transferred to a new 96-well plate containing 40 ul $H_2SO4$ 1M per well and absorbance was measured 450 nM. Clones exhibiting significant signals over background were subjected to a kinetic screening experiment by SPR-analysis using ProteOn XPR36.

7.2.1.4 Identification of Affinity-Matured 8B8-Derived Variants by SPR

In order to further characterize the ELISA-positive clones, the off-rate was measured by surface plasmon resonance and compared with the parental humanized clone 8B8.

For this experiment, 7000 RU of polyclonal anti-human Fab antibody were immobilized on all 6 channels of a GLM chip by Amine coupling (NaAcetate pH4.5, 25 µl/min, 240s) (vertical orientation). Each antibody-containing bacterial supernatant was filtered and 2-fold diluted with PBS, and then injected for 360s at 25 µl/minute to achieve immobilization levels of between 100 and 400 response units (RU) in vertical orientation. Injection of monomeric CD19-Fc: For one-shot kinetics measurements, injection direction was changed to horizontal orientation, three-fold dilution series of purified monomeric CD19-Fc (varying concentration ranges between 150 and 6 nM) were injected simultaneously at 50 µl/min along separate channels 1-4, with association times of 180 s, and dissociation times of 300 s. A human IgG Fc fragment (150 nM) was injected in channel 5 as a negative control for specific binding to monomeric CD19-Fc Buffer (PBST) was injected along the sixth channel to provide an "in-line" blank for referencing. Regeneration was performed by two pulses of 10 mM glycine pH 1.5 and 50 mM NaOH for 30s at 90 ul/min (horizontal orientation). Dissociation rate constants ($k_{off}$) were calculated using a simple one-to-one Langmuir binding model in ProteOn Manager v3.1 software by simultaneously fitting the sensorgrams. Clones expressing Fabs with the slowest dissociation rate constants were identified (Table 55). Of note, the dissociation rate constants of clones 5A07 and 5B08 could not be determined due to inadequate fitting. Nevertheless, both clones were selected because results obtained suggested a very slow dissociation. The variable domains of the corresponding phagemids were sequenced. Importantly, both asparagine residue in LCDR1 (position 27d and 28) were replaced by a serine or a threonine, demonstrating that both de-amidation sites were removed. An alignment is shown in FIGS. 32A and 32B. The CDRs of the best clones are listed in Table 56 (variable regions of the light chain) and Table 57 (variable regions of the heavy chain) (clone 5H09: (SEQ ID NO:231-236); clone 7H07: (SEQ ID NO:237-242); clone 2B03: (SEQ ID NO: 243-248); clone 2B11: (SEQ ID NO:249-254); clone 5A07: (SEQ ID NO:255-260); clone 5B08: (SEQ ID NO:261-266); clone 5D08: (SEQ ID NO:267-272).

TABLE 55

Dissociation constants of selected clones obtained in screening analysis with bacterial supernatant

| clone | Dissociation constant kd (1/s) |
| --- | --- |
| Parental 8B8 | 3.01E−4 |
| 5H09 | 2.58E−4 |
| 7H07 | 5.75E−5 |
| 2B03 | 3.24E−5 |
| 2B11 | 4.37E−6 |
| 5A07 | n.d. |
| 5B08 | n.d. |
| 5D08 | 1.95E−4 |

TABLE 56

CDR sequences of the selected 8B8 light chains

| clone | SEQ ID NO | CDR-L1 | SEQ ID NO | CDR-L2 | SEQ ID NO | CDR-L3 |
| --- | --- | --- | --- | --- | --- | --- |
| 5H09 | 231 | KSSQSLESSTGNTYLN | 232 | RVSKRFS | 233 | LQLIDYPVT |
| 7H07 | 237 | KSSQSLETSTGNTYLN | 238 | RVSKRFS | 239 | LQATHIPYT |
| 2B03 | 243 | KSSQSLETSTGNTYLN | 244 | RVSKRFS | 245 | LQLTHVPYT |
| 2B11 | 249 | KSSQSLETSTGTTYLN | 250 | RVSKRFS | 251 | LQLLEDPYT |
| 5A07 | 255 | KSSQSLETSTGNTYLN | 256 | RVSKRFS | 257 | LQPGHYPGT |
| 5B08 | 261 | KSSQSLETSTGNTYLN | 262 | RVSKRFS | 263 | LQLDSYPNT |
| 5D08 | 267 | KSSQSLETSTGNTYLN | 268 | RVSKRFS | 269 | LQLTHEPYT |

TABLE 57

CDR sequences of the selected 8B8 heavy chains

| clone | SEQ ID NO | CDR-H1 | SEQ ID NO | CDR-H2 | SEQ ID NO | CDR-H3 |
| --- | --- | --- | --- | --- | --- | --- |
| 5H09 | 234 | DYIMH | 235 | YINPYNDGSKYTEKFQG | 236 | GTYYYGSALFDY |
| 7H07 | 240 | DYIMH | 241 | YINPYNDGSKYTEKFQG | 242 | GTYYYGSELFDY |
| 2B03 | 246 | DYITH | 247 | YINPYNDGSKYTEKFQG | 248 | GTYYYGPDLFDY |
| 2B11 | 252 | DYIMH | 253 | YINPYNDGSKYTEKFQG | 254 | GTYYYGPQLFDY |
| 5A07 | 258 | DYIMH | 259 | YINPYNDGSKYTEKFQG | 260 | GTYYYGSALFDY |
| 5B08 | 264 | DYIMH | 265 | YINPYNDGSKYTEKFQG | 266 | GTYYYGPQLFDY |
| 5D08 | 270 | DYIMH | 271 | YINPYNDGSKYTEKFQG | 272 | GTYYYGSELFDY |

7.2.2 Characterization of Affinity-Matured 8B8-Derived Antibodies 7.2.2.1 Cloning of Variable Antibody Domains into Expression Vectors The variable regions of heavy and light chain DNA sequences of the selected anti-CD19 binders were subcloned in frame with either the constant heavy chain or the constant light chain of human IgG1. In the heavy chain, Pro329Gly, Leu234Ala and Leu235Ala mutations have been introduced in order to abrogate binding to Fc gamma receptors according to the method described in International Patent Appl. Publ. No. WO 2012/130831 A1.

The cDNA and amino acid sequences of the anti-CD19 IgGs are shown in Table 58 and Table 59, respectively. All antibody-encoding sequences were cloned into an expression vector, which drives transcription of the insert with a chimeric MPSV promoter and contains a synthetic polyA signal sequence located at the 3' end of the CDS. In addition, the vector contains an EBV OriP sequence for episomal maintenance of the plasmid.

TABLE 58 cDNA and amino acid sequences of anti-CD19 clone 8B8 in P329GLALA human IgG1 format

| SEQ ID NO: | Clone and Chain | Sequence |
|---|---|---|
| 273 | 8B8 Parental light chain | GATGCTGTGATGACCCAAACTCCACTCTCCCTGCCTGTCAGTCTTGGA GATCAAGCCTCCATCTCTTGCAGGTCTAGTCAGAGCCTTGAAAACAGT AATGGAAACACCTATTTGAACTGGTACCTCCAGAAACCAGGCCAGTC TCCACAACTCCTGATCTACAGGGTTTCCAAACGATTTTCTGGGGTCCT AGACAGGTTCAGTGGTAGTGGATCAGGGACAGATTTCACACTGAAAA TCAGCAGAGTGGAGGCTGAGGATTTGGGAGTTTATTTCTGCCTACAA CTTACACATGTCCCGTACACGTTCGGAGGGGGGACCAAGCTGGAAAT AAAACGTACGGTGGCTGCACCATCTGTCTTCATCTTCCCGCCATCTGATG AGCAGTTGAAATCTGGAACTGCCTCTGTTGTGTGCCTGCTGAATAACTTCT ATCCCAGAGAGGCCAAAGTACAGTGGAAGGTGGATAACGCCCTCCAATCG GGTAACTCCCAGGAGAGTGTCACAGAGCAGGACAGCAAGGACAGCACCT ACAGCCTCAGCAGCACCCTGACGCTGAGCAAAGCAGACTACGAGAAACAC AAAGTCTACGCCTGCGAAGTCACCCATCAGGGCCTGAGCTCGCCCGTCAC AAAGAGCTTCAACAGGGGAGAGTGT |
| 274 | 8B8 parental heavy chain | GAGGTCCAGCTGCAGCAGTCTGGACCTGAGCTGGTAAAGCCTGGGGC TTCAGTGAAGATGGCCTGCAAGGCTTCTGGATACACATTCACTGACTA TATTATGCACTGGGTGAAGCAGAAGACTGGGCAGGGCCTTGAGTGGA TTGGATATATTAATCCTTACAATGATGGTTCTAAGTACACTGAGAAGT TCAACGGCAAGGCCACACTGACTTCAGACAAATCTTCCATCACAGCC TACATGGAGCTCAGCAGCCTGACCTCTGAGGACTCTGCGGTCTATTAC TGTGCAAGAGGGACCTATTATTATGGTAGCGCCCTCTTTGACTACTGG GGCCAAGGCACCACTCTCACAGTCTCCTCGGCTAGCACCAAGGGCCCA TCGGTCTTCCCCCTGGCACCCTCCTCCAAGAGCACCTCTGGGGGCACAGC GGCCCTGGGCTGCCTGGTCAAGGACTACTTCCCCGAACCGGTGACGGTG TCGTGGAACTCAGGCGCCCTGACCAGCGGCGTGCACACCTTCCCGGCTG TCCTACAGTCCTCAGGACTCTACTCCCTCAGCAGCGTGGTGACCGTGCCC TCCAGCAGCTTGGGCACCCAGACCTACATCTGCAACGTGAATCACAAGCC CAGCAACACCAAGGTGGACAAGAAAGTTGAGCCCAAATCTTGTGACAAAA CTCACACATGCCCACCGTGCCCAGCACCTGAAGCTGCAGGGGGACCGTC AGTCTTCCTCTTCCCCCCAAAACCCAAGGACACCCTCATGATCTCCCGGAC CCCTGAGGTCACATGCGTGGTGGTGGACGTGAGCCACGAAGACCCTGAG GTCAAGTTCAACTGGTACGTGGACGGCGTGGAGGTGCATAATGCCAAGAC AAAGCCGCGGGAGGAGCAGTACAACAGCACGTACCGTGTGGTCAGCGTC CTCACCGTCCTGCACCAGGACTGGCTGAATGGCAAGGAGTACAAGTGCAA GGTCTCCAACAAAGCCCTCGGCGCCCCCATCGAGAAAACCATCTCCAAAG CCAAAGGGCAGCCCCGAGAACCACAGGTGTACACCCTGCCCCCATCCCG GGATGAGCTGACCAAGAACCAGGTCAGCCTGACCTGCCTGGTCAAAGGCT TCTATCCCAGCGACATCGCCGTGGAGTGGGAGAGCAATGGGCAGCCGGA GAACAACTACAAGACCACGCCTCCCGTGCTGGACTCCGACGGCTCCTTCT TCCTCTACAGCAAGCTCACCGTGGACAAGAGCAGGTGGCAGCAGGGGAA CGTCTTCTCATGCTCCGTGATGCATGAGGCTCTGCACAACCACTACACGCA GAAGAGCCTCTCCCTGTCTCCGGGTAAA |
| 275 | 8B8 Parental light chain | DAVMTQTPLSLPVSLGDQASISCRSSQSLENSNGNTYLNWYLQKPGQSP QLLIYRVSKRFSGVLDRFSGSGSGTDFTLKISRVEAEDLGVYFCLQLTHVP YTFGGGTKLEIKRTVAAPSVFIFPPSDEQLKSGTASVVCLLNNFYPREAKVQW KVDNALQSGNSQESVTEQDSKDSTYSLSSTLTLSKADYEKHKVYACEVTHQGL SSPVTKSFNRGEC |
| 276 | 8B8 parental heavy chain | EVQLQQSGPELVKPGASVKMACKASGYTFTDYIMHWVKQKTGQGLEWI GYINPYNDGSKYTEKFNGKATLTSDKSSITAYMELSSLTSEDSAVYYCAR GTYYYGSALFDYWGQGTTLTVSSASTKGPSVFPLAPSSKSTSGGTAALGCL VKDYFPEPVTVSWNSGALTSGVHTFPAVLQSSGLYSLSSVVTVPSSSLGTQTYIC NVNHKPSNTKVDKKVEPKSCDKTHTCPPCPAPEAAGGPSVFLFPPKPKDTL MISRTPEVTCVVVDVSHEDPEVKFNWYVDGVEVHNAKTKPREEQYNSTYRVV SVLTVLHQDWLNGKEYKCKVSNKALGAPIEKTISKAKGQPREPQVYTLPPSRD ELTKNQVSLTCLVKGFYPSDIAVEWESNGQPENNYKTTPPVLDSDGSFFLYSK LTVDKSRWQQGNVFSCSVMHEALHNHYTQKSLSLSPGK |

TABLE 59 cDNA and amino acid sequences of affinity matured anti-CD19 clones in P329GLALA human IgG1 format

| SEQ ID NO: | Clone and Chain | Sequence |
|---|---|---|
| 277 | 2B11 light chain | GATATTGTCATGACTCAAACTCCACTGTCTCTGTCCGTGACCCCGGGT<br>CAGCCAGCGAGCATTTCTTGCAAATCCAGCCAATCTCTGGAAACCTCC<br>ACCGGCACCACGTACCTGAACTGGTATCTCCAGAAACCGGGTCAGAG<br>CCCGCAGCTGCTGATCTACCGTGTATCTAAGCGCTTCTCCGGCGTTCC<br>TGATCGTTTCAGCGGTTCTGGATCCGGCACCGACTTTACTCTGAAAAT<br>CAGCCGTGTGGAAGCTGAAGACGTTGGCGTCTACTATTGTCTGCAGCT<br>GCTGGAAGATCCATACACCTTCGGTCAAGGAACGAAACTGGAAATTA<br>AACGTACGGTGGCTGCACCATCTGTCTTCATCTTCCCGCCATCTGATG<br>AGCAGTTGAAATCTGGAACTGCCTCTGTTGTGTGCCTGCTGAATAACT<br>TCTATCCCAGAGAGGCCAAAGTACAGTGGAAGGTGGATAACGCCCTC<br>CAATCGGGTAACTCCCAGGAGAGTGTCACAGAGCAGGACAGCAAGG<br>ACAGCACCTACAGCCTCAGCAGCACCCTGACGCTGAGCAAAGCAGAC<br>TACGAGAAACACAAAGTCTACGCCTGCGAAGTCACCCATCAGGGCCT<br>GAGCTCGCCCGTCACAAAGAGCTTCAACAGGGGAGAGTGT |
| 278 | 2B11 heavy chain | CAGGTGCAATTGGTTCAATCTGGTGCTGAAGTAAAAAAACCGGGCGC<br>TTCCGTTAAAGTGAGCTGCAAAGCATCTGGTTACACCTTCACTGACTA<br>TATCATGCACTGGGTTCGTCAGGCCCCGGGCCAGGGTCTGGAGTGGA<br>TGGGCTACATTAACCCATACAACGACGGTTCCAAATATACCGAGAAA<br>TTCCAGGGCCGCGTCACGATGACCAGCGACACTTCTATCTCCACCGCG<br>TACATGGAACTGTCTAGACTGCGTTCTGACGACACCGCTGTTTACTAT<br>TGTGCACGCGGTACCTACTACTACGGTCCACAGCTGTTTGATTACTGG<br>GGCCAAGGTACCACGGTGACCGTAAGCTCTGCTAGCACCAAGGGCCC<br>ATCGGTCTTCCCCCTGGCACCCTCCTCCAAGAGCACCTCTGGGGGCAC<br>AGCGGCCCTGGGCTGCCTGGTCAAGGACTACTTCCCCGAACCGGTGA<br>CGGTGTCGTGGAACTCAGGCGCCCTGACCAGCGGCGTGCACACCTTC<br>CCGGCTGTCCTACAGTCCTCAGGACTCTACTCCCTCAGCAGCGTGGTG<br>ACCGTGCCCTCCAGCAGCTTGGGCACCCAGACCTACATCTGCAACGT<br>GAATCACAAGCCCAGCAACACCAAGGTGGACAAGAAAGTTGAGCCC<br>AAATCTTGTGACAAAACTCACACATGCCCACCGTGCCCAGCACCTGA<br>AGCTGCAGGGGGACCGTCAGTCTTCCTCTTCCCCCCAAAACCCAAGG<br>ACACCCTCATGATCTCCCGGACCCCTGAGGTCACATGCGTGGTGGTG<br>GACGTGAGCCACGAAGACCCTGAGGTCAAGTTCAACTGGTACGTGGA<br>CGGCGTGGAGGTGCATAATGCCAAGACAAAGCCGCGGGAGGAGCAG<br>TACAACAGCACGTACCGTGTGGTCAGCGTCCTCACCGTCCTGCACCA<br>GGACTGGCTGAATGGCAAGGAGTACAAGTGCAAGGTCTCCAACAAA<br>GCCCTCGGCGCCCCCATCGAGAAAACCATCTCCAAAGCCAAAGGGCA<br>GCCCCGAGAACCACAGGTGTACACCCTGCCCCCATCCCGGGATGAGC<br>TGACCAAGAACCAGGTCAGCCTGACCTGCCTGGTCAAAGGCTTCTAT<br>CCCAGCGACATCGCCGTGGAGTGGGAGAGCAATGGGCAGCCGGAGA<br>ACAACTACAAGACCACGCCTCCCGTGCTGGACTCCGACGGCTCCTTCT<br>TCCTCTACAGCAAGCTCACCGTGGACAAGAGCAGGTGGCAGCAGGGG<br>AACGTCTTCTCATGCTCCGTGATGCATGAGGCTCTGCACAACCACTAC<br>ACGCAGAAGAGCCTCTCCCTGTCTCCGGGTAAA |
| 279 | 2B11 light chain | DIVMTQTPLSLSVTPGQPASISCKSSQSLETSTGTTYLNWYLQKPGQSPQL<br>LIYRVSKRFSGVPDRFSGSGSGTDFTLKISRVEAEDVGVYYCLQLLEDPY<br>TFGQGTKLEIKRTVAAPSVFIFPPSDEQLKSGTASVVCLLNNFYPREAKV<br>QWKVDNALQSGNSQESVTEQDSKDSTYSLSSTLTLSKADYEKHKVYAC<br>EVTHQGLSSPVTKSFNRGEC |
| 280 | 2B11 heavy chain | QVQLVQSGAEVKKPGASVKVSCKASGYTFTDYIMHWVRQAPGQGLEW<br>MGYINPYNDGSKYTEKFQGRVTMTSDTSISTAYMELSRLRSDDTAVYYC<br>ARGTYYYGPQLFDYWGQGTTVTVSSASTKGPSVFPLAPSSKSTSGGTAA<br>LGCLVKDYFPEPVTVSWNSGALTSGVHTFPAVLQSSGLYSLSSVVTVPSS<br>SLGTQTYICNVNHKPSNTKVDKKVEPKSCDKTHTCPPCPAPEAAGGPSVF<br>LFPPKPKDTLMISRTPEVTCVVVDVSHEDPEVKFNWYVDGVEVHNAKT<br>KPREEQYNSTYRVVSVLTVLHQDWLNGKEYKCKVSNKALGAPIEKTISK<br>AKGQPREPQVYTLPPSRDELTKNQVSLTCLVKGFYPSDIAVEWESNGQPE<br>NNYKTTPPVLDSDGSFFLYSKLTVDKSRWQQGNVFSCSVMHEALHNHY<br>TQKSLSLSPGK |
| 281 | 7H07 light chain | GATATTGTTATGACTCAAACTCCACTGTCTCTGTCCGTGACCCCGGGT<br>CAGCCAGCGAGCATTTCTTGCAAATCCAGCCAATCTCTGGAAACCTCC<br>ACCGGCAACACGTACCTGAACTGGTATCTCCAGAAACCGGGTCAGAG<br>CCCGCAGCTGCTGATCTACCGTGTATCTAAGCGCTTCTCCGGCGTTCC<br>TGATCGTTTCAGCGGTTCTGGATCCGGCACCGACTTTACTCTGAAAAT<br>CAGCCGTGTGGAAGCTGAAGACGTTGGCGTCTACTATTGTCTGCAGG<br>CAACCCATATCCCATACACCTTCGGTCAAGGAACTAAACTGGAAATT<br>AAACGTACGGTGGCTGCACCATCTGTCTTCATCTTCCCGCCATCTGAT<br>GAGCAGTTGAAATCTGGAACTGCCTCTGTTGTGTGCCTGCTGAATAAC<br>TTCTATCCCAGAGAGGCCAAAGTACAGTGGAAGGTGGATAACGCCCT<br>CCAATCGGGTAACTCCCAGGAGAGTGTCACAGAGCAGGACAGCAAG |

TABLE 59-continued cDNA and amino acid sequences of affinity matured anti-CD19
clones in P329GLALA human IgG1 format

| SEQ ID NO: | Clone and Chain | Sequence |
|---|---|---|
| | | GACAGCACCTACAGCCTCAGCAGCACCCTGACGCTGAGCAAAGCAGA<br>CTACGAGAAACACAAAGTCTACGCCTGCGAAGTCACCCATCAGGGCC<br>TGAGCTCGCCCGTCACAAAGAGCTTCAACAGGGGAGAGTGT |
| 282 | 7H07 heavy chain | CAGGTGCAATTGGTTCAATCTGGTGCTGAAGTAAAAAAACCGGGCGC<br>TTCCGTTAAAGTGAGCTGCAAAGCATCTGGTTACACCTTCACTGACTA<br>TATCATGCACTGGGTTCGTCAGGCCCGGGCCAGGGTCTGGAGTGGA<br>TGGGCTACATTAACCCATACAACGACGGTTCCAAATATACCGAGAAA<br>TTCCAGGGCCGCGTCACGATGACCAGCGACACTTCTATCTCCACCGCG<br>TACATGGAACTGTCTAGACTGCGTTCTGACGACACCGCTGTTTACTAT<br>TGTGCACGCGGTACCTACTACTACGGTTCTGAACTGTTTGATTACTGG<br>GGCCAAGGTACCACGGTGACCGTAAGCTCTGCTAGCACCAAGGGCCC<br>ATCGGTCTTCCCCCTGGCACCCTCCTCCAAGAGCACCTCTGGGGGCAC<br>AGCGGCCCTGGGCTGCCTGGTCAAGGACTACTTCCCCGAACCGGTGA<br>CGGTGTCGTGGAACTCAGGCGCCCTGACCAGCGGCGTGCACACCTTC<br>CCGGCTGTCCTACAGTCCTCAGGACTCTACTCCCTCAGCAGCGTGGTG<br>ACCGTGCCCTCCAGCAGCTTGGGCACCCAGACCTACATCTGCAACGT<br>GAATCACAAGCCCAGCAACACCAAGGTGGACAAGAAAGTTGAGCCC<br>AAATCTTGTGACAAAACTCACACATGCCCACCGTGCCCAGCACCTGA<br>AGCTGCAGGGGACCGTCAGTCTTCCTCTTCCCCCCAAAACCCAAGG<br>ACACCCTCATGATCTCCCGGACCCCTGAGGTCACATGCGTGGTGGTG<br>GACGTGAGCCACGAAGACCCTGAGGTCAAGTTCAACTGGTACGTGGA<br>CGGCGTGGAGGTGCATAATGCCAAGACAAAGCCGCGGGAGGAGCAG<br>TACAACAGCACGTACCGTGTGGTCAGCGTCCTCACCGTCCTGCACCA<br>GGACTGGCTGAATGGCAAGGAGTACAAGTGCAAGGTCTCCAACAAA<br>GCCCTCGGCGCCCCCATCGAGAAAACCATCTCCAAAGCCAAAGGGCA<br>GCCCCGAGAACCACAGGTGTACACCCTGCCCCCATCCCGGGATGAGC<br>TGACCAAGAACCAGGTCAGCCTGACCTGCCTGGTCAAAGGCTTCTAT<br>CCCAGCGACATCGCCGTGGAGTGGGAGAGCAATGGGCAGCCGGAGA<br>ACAACTACAAGACCACGCCTCCCGTGCTGGACTCCGACGGCTCCTTCT<br>TCCTCTACAGCAAGCTCACCGTGGACAAGAGCAGGTGGCAGCAGGGG<br>AACGTCTTCTCATGCTCCGTGATGCATGAGGCTCTGCACAACCACTAC<br>ACGCAGAAGAGCCTCTCCCTGTCTCCGGGTAAA |
| 283 | 7H07 light chain | DIVMTQTPLSLSVTPGQPASISCKSSQSLETSTGNTYLNWYLQKPGQSPQL<br>LIYRVSKRFSGVPDRFSGSGSGTDFTLKISRVEAEDVGVYYCLQATHIPYT<br>FGQGTKLEIKRTVAAPSVFIFPPSDEQLKSGTASVVCLLNNFYPREAKVQ<br>WKVDNALQSGNSQESVTEQDSKDSTYSLSSTLTLSKADYEKHKVYACE<br>VTHQGLSSPVTKSFNRGEC |
| 284 | 7H07 heavy chain | QVQLVQSGAEVKKPGASVKVSCKASGYTFTDYIMHWVRQAPGQGLEW<br>MGYINPYNDGSKYTEKFQGRVTMTSDTSISTAYMELSRLRSDDTAVYYC<br>ARGTYYYGSELFDYWGQGTTVTVSSASTKGPSVFPLAPSSKSTSGGTAA<br>LGCLVKDYFPEPVTVSWNSGALTSGVHTFPAVLQSSGLYSLSSVVTVPSS<br>SLGTQTYICNVNHKPSNTKVDKKVEPKSCDKTHTCPPCPAPEAAGGPSVF<br>LFPPKPKDTLMISRTPEVTCVVVDVSHEDPEVKFNWYVDGVEVHNAKT<br>KPREEQYNSTYRVVSVLTVLHQDWLNGKEYKCKVSNKALGAPIEKTISK<br>AKGQPREPQVYTLPPSRDELTKNQVSLTCLVKGFYPSDIAVEWESNGQPE<br>NNYKTTPPVLDSDGSFFLYSKLTVDKSRWQQGNVFSCSVMHEALHNHY<br>TQKSLSLSPGK |
| 285 | 2B03 light chain | GATATTGTTATGACTCAAACTCCACTGTCTCTGTCCGTGACCCCGGGT<br>CAGCCAGCGAGCATTTCTTGCAAATCCAGCCAATCTCTGGAAACCTC<br>CACCGGCAACACGTACCTGAACTGGTATCTCCAGAAACCGGGTCAGA<br>GCCCGCAGCTGCTGATCTACCGTGTATCTAAGCGCTTCTCCGGCGTTC<br>CTGATCGTTTCAGCGGTTCTGGATCCGGCACCGACTTTACTCTGAAAA<br>TCAGCCGTGTGGAAGCTGAAGACGTTGGCGTCTACTATTGTCTGCAG<br>TTGACCCACGTTCCGTACACCTTCGGTCAAGGAANNAAACTGGAAAT<br>TAAACGTACGGTGGCTGCACCATCTGTCTTCATCTTCCCGCCATCTGA<br>TGAGCAGTTGAAATCTGGAACTGCCTCTGTTGTGTGCCTGCTGAATAA<br>CTTCTATCCCAGAGAGGCCAAAGTACAGTGGAAGGTGGATAACGCCC<br>TCCAATCGGGTAACTCCCAGGAGAGTGTCACAGAGCAGGACAGCAA<br>GGACAGCACCTACAGCCTCAGCAGCACCCTGACGCTGAGCAAAGCA<br>GACTACGAGAAACACAAAGTCTACGCCTGCGAAGTCACCCATCAGG<br>CCTGAGCTCGCCCGTCACAAAGAGCTTCAACAGGGGAGAGTGT |
| 286 | 2B03 heavy chain | CAGGTGCAATTGGTTCAATCTGGTGCTGAAGTAAAAAAACCGGGCGC<br>TTCCGTTAAAGTGAGCTGCAAAGCATCTGGTTACACCTTCACTGACTA<br>TATCACGCACTGGGTTCGTCAGGCCCGGGCCAGGGTCTGGAGTGGA<br>TGGGCTACATTAACCCATACAACGACGGTTCCAAATATACCGAGAAA<br>TTCCAGGGCCGCGTCACGATGACCAGCGACACTTCTATCTCCACCGC<br>GTACATGGAACTGTCTAGACTGCGTTCTGACGACACCGCTGTTTACTA<br>TTGTGCACGCGGTACCTACTACTACGGTCCAGATCTGTTTGATTACTG |

TABLE 59-continued cDNA and amino acid sequences of affinity matured anti-CD19 clones in P329GLALA human IgG1 format

| SEQ ID NO: | Clone and Chain | Sequence |
|---|---|---|
| | | GGGCCAAGGTACCACGGTGACCGTAAGCTCTGCTAGCACCAAGGGCC<br>CATCGGTCTTCCCCCTGGCACCCTCCTCCAAGAGCACCTCTGGGGGCA<br>CAGCGGCCCTGGGCTGCCTGGTCAAGGACTACTTCCCCGAACCGGTG<br>ACGGTGTCGTGGAACTCAGGCGCCCTGACCAGCGGCGTGCACACCTT<br>CCCGGCTGTCCTACAGTCCTCAGGACTCTACTCCCTCAGCAGCGTGGT<br>GACCGTGCCCTCCAGCAGCTTGGGCACCCAGACCTACATCTGCAACG<br>TGAATCACAAGCCCAGCAACACCAAGGTGGACAAGAAAGTTGAGCC<br>CAAATCTTGTGACAAAACTCACACATGCCCACCGTGCCCAGCACCTG<br>AAGCTGCAGGGGACCGTCAGTCTTCCTCTTCCCCCCAAAACCCAAG<br>GACACCCTCATGATCTCCCGGACCCCTGAGGTCACATGCGTGGTGGT<br>GGACGTGAGCCACGAAGACCCTGAGGTCAAGTTCAACTGGTACGTGG<br>ACGGCGTGGAGGTGCATAATGCCAAGACAAAGCCGCGGGAGGAGCA<br>GTACAACAGCACGTACCGTGTGGTCAGCGTCCTCACCGTCCTGCACC<br>AGGACTGGCTGAATGGCAAGGAGTACAAGTGCAAGGTCTCCAACAA<br>AGCCCTCGGCGCCCCCATCGAGAAAACCATCTCCAAAGCCAAAGGGC<br>AGCCCCGAGAACCACAGGTGTACACCCTGCCCCCATCCCGGGATGAG<br>CTGACCAAGAACCAGGTCAGCCTGACCTGCCTGGTCAAAGGCTTCTA<br>TCCCAGCGACATCGCCGTGGAGTGGGAGAGCAATGGGCAGCCGGAG<br>AACAACTACAAGACCACGCCTCCCGTGCTGGACTCCGACGGCTCCTT<br>CTTCCTCTACAGCAAGCTCACCGTGGACAAGAGCAGGTGGCAGCAGG<br>GGAACGTCTTCTCATGCTCCGTGATGCATGAGGCTCTGCACAACCACT<br>ACACGCAGAAGAGCCTCTCCCTGTCTCCGGGTAAA |
| | 2872B03 light chain | DIVMTQTPLSLSVTPGQPASISCKSSQSLETSTGNTYLNWYLQKPGQSPQ<br>LLIYRVSKRFSGVPDRFSGSGSGTDFTLKISRVEAEDVGVYYCLQLTHVP<br>YTFGQGXKLEIKRTVAAPSVFIFPPSDEQLKSGTASVVCLLNNFYPREAK<br>VQWKVDNALQSGNSQESVTEQDSKDSTYSLSSTLTLSKADYEKHKVYA<br>CEVTHQGLSSPVTKSFNRGEC |
| | 2882B03 heavy chain | QVQLVQSGAEVKKPGASVKVSCKASGYTFTDYITHWVRQAPGQGLEW<br>MGYINPYNDGSKYTEKFQGRVTMTSDTSISTAYMELSRLRSDDTAVYYC<br>ARGTYYYGPDLFDYWGQGTTVTVSSASTKGPSVFPLAPSSKSTSGGTAA<br>LGCLVKDYFPEPVTVSWNSGALTSGVHTFPAVLQSSGLYSLSSVVTVPSS<br>SLGTQTYICNVNHKPSNTKVDKKVEPKSCDKTHTCPPCPAPEAAGGPSV<br>FLFPPKPKDTLMISRTPEVTCVVVDVSHEDPEVKFNWYVDGVEVHNAKT<br>KPREEQYNSTYRVVSVLTVLHQDWLNGKEYKCKVSNKALGAPIEKTISK<br>AKGQPREPQVYTLPPSRDELTKNQVSLTCLVKGFYPSDIAVEWESNGQP<br>ENNYKTTPPVLDSDGSFFLYSKLTVDKSRWQQGNVFSCSVMHEALHNH<br>YTQKSLSLSPGK |
| | 2895A07 light chain | GATATTGTTATGACTCAAACTCCACTGTCTCTGTCCGTGACCCCGGGT<br>CAGCCAGCGAGCATTTCTTGCAAATCCAGCCAATCTCTGGAAACCTC<br>CACCGGCAACACGTACCTGAACTGGTATCTCCAGAAACCGGGTCAGA<br>GCCCGCAGCTGCTGATCTACCGTGTATCTAAGCGCTTCTCCGGCGTTC<br>CTGATCGTTTCAGCGGTTCTGGATCCGGCACCGACTTTACTCTGAAAA<br>TCAGCCGTGTGGAAGCTGAAGACGTTGGCGTCTACTATTGTCTGCAG<br>CCAGGTCATTACCCAGGTACCTTCGGTCAAGGAACTAAACTGGAAAT<br>TAAACGTACGGTGGCTGCACCATCGTCTTCATCTTCCCGCCATCTGA<br>TGAGCAGTTGAAATCTGGAACTGCCTCTGTTGTGTGCCTGCTGAATAA<br>CTTCTATCCCAGAGAGGCCAAAGTACAGTGGAAGGTGGATAACGCCC<br>TCCAATCGGGTAACTCCCAGGAGAGTGTCACAGAGCAGGACAGCAA<br>GGACAGCACCTACAGCCTCAGCAGCACCCTGACGCTGAGCAAAGCA<br>GACTACGAGAAACACAAAGTCTACGCCTGCGAAGTCACCCATCAGGG<br>CCTGAGCTCGCCCGTCACAAAGAGCTTCAACAGGGGAGAGTGT |
| | 2905A07 heavy chain | CAGGTGCAATTGGTTCAATCTGGTGCTGAAGTAAAAAAACCGGGCGC<br>TTCCGTTAAAGTGAGCTGCAAAGCATCTGGTTACACCTTCACTGACTA<br>TATCATGCACTGGGTTCGTCAGGCCCCGGGCCAGGGTCTGGAGTGGA<br>TGGGCTACATTAACCCATACAACGACGGTTCCAAATATACCGAGAAA<br>TTCCAGGGCCGCGTCACGATGACCAGCGACACTTCTATCTCCACCGC<br>GTACATGGAACTGTCTAGACTGCGTTCTGACGACACCGCTGTTTACTA<br>TTGTGCACGCGGTACTTACTACTACGGTTCCGCCCTCTTTGATTACTG<br>GGGCCAAGGTACCACGGTGACCGTAAGCTCTGCTAGCACCAAGGGCC<br>CATCGGTCTTCCCCCTGGCACCCTCCTCCAAGAGCACCTCTGGGGGCA<br>CAGCGGCCCTGGGCTGCCTGGTCAAGGACTACTTCCCCGAACCGGTG<br>ACGGTGTCGTGGAACTCAGGCGCCCTGACCAGCGGCGTGCACACCTT<br>CCCGGCTGTCCTACAGTCCTCAGGACTCTACTCCCTCAGCAGCGTGGT<br>GACCGTGCCCTCCAGCAGCTTGGGCACCCAGACCTACATCTGCAACG<br>TGAATCACAAGCCCAGCAACACCAAGGTGGACAAGAAAGTTGAGCC<br>CAAATCTTGTGACAAAACTCACACATGCCCACCGTGCCCAGCACCTG<br>AAGCTGCAGGGGACCGTCAGTCTTCCTCTTCCCCCCAAAACCCAAG<br>GACACCCTCATGATCTCCCGGACCCCTGAGGTCACATGCGTGGTGGT<br>GGACGTGAGCCACGAAGACCCTGAGGTCAAGTTCAACTGGTACGTGG |

TABLE 59-continued cDNA and amino acid sequences of affinity matured anti-CD19 clones in P329GLALA human IgG1 format

| SEQ ID NO: | Clone and Chain | Sequence |
|---|---|---|
| | | ACGGCGTGGAGGTGCATAATGCCAAGACAAAGCCGCGGGAGGAGCA<br>GTACAACAGCACGTACCGTGTGGTCAGCGTCCTCACCGTCCTGCACC<br>AGGACTGGCTGAATGGCAAGGAGTACAAGTGCAAGGTCTCCAACAA<br>AGCCCTCGGCGCCCCCATCGAGAAAACCATCTCCAAAGCCAAAGGGC<br>AGCCCCGAGAACCACAGGTGTACACCCTGCCCCCATCCCGGGATGAG<br>CTGACCAAGAACCAGGTCAGCCTGACCTGCCTGGTCAAAGGCTTCTA<br>TCCCAGCGACATCGCCGTGGAGTGGGAGAGCAATGGGCAGCCGGAG<br>AACAACTACAAGACCACGCCTCCCGTGCTGGACTCCGACGGCTCCTT<br>CTTCCTCTACAGCAAGCTCACCGTGGACAAGAGCAGGTGGCAGCAGG<br>GGAACGTCTTCTCATGCTCCGTGATGCATGAGGCTCTGCACAACCACT<br>ACACGCAGAAGAGCCTCTCCCTGTCTCCGGGTAAA |
| 291 | 5A07 light chain | DIVMTQTPLSLSVTPGQPASISCKSSQSLETSTGNTYLNWYLQKPGQSPQ<br>LLIYRVSKRFSGVPDRFSGSGSGTDFTLKISRVEAEDVGVYYCLQPGHYP<br>GTFGQGTKLEIKRTVAAPSVFIFPPSDEQLKSGTASVVCLLNNFYPREAK<br>VQWKVDNALQSGNSQESVTEQDSKDSTYSLSSTLTLSKADYEKHKVYA<br>CEVTHQGLSSPVTKSFNRGEC |
| 292 | 5A07 heavy chain | QVQLVQSGAEVKKPGASVKVSCKASGYTFTDYIMHWVRQAPGQGLEW<br>MGYINPYNDGSKYTEKFQGRVTMTSDTSISTAYMELSRLRSDDTAVYYC<br>ARGTYYYGSALFDYWGQGTTVTVSSASTKGPSVFPLAPSSKSTSGGTAA<br>LGCLVKDYFPEPVTVSWNSGALTSGVHTFPAVLQSSGLYSLSSVVTVPSS<br>SLGTQTYICNVNHKPSNTKVDKKVEPKSCDKTHTCPPCPAPEAAGGPSV<br>FLFPPKPKDTLMISRTPEVTCVVVDVSHEDPEVKFNWYVDGVEVHNAKT<br>KPREEQYNSTYRVVSVLTVLHQDWLNGKEYKCKVSNKALGAPIEKTISK<br>AKGQPREPQVYTLPPSRDELTKNQVSLTCLVKGFYPSDIAVEWESNGQP<br>ENNYKTTPPVLDSDGSFFLYSKLTVDKSRWQQGNVFSCSVMHEALHNH<br>YTQKSLSLSPGK |
| 293 | 5D08 light chain | GATATTGTTATGACTCAAACTCCACTGTCTCTGTCCGTGACCCCGGGT<br>CAGCCAGCGAGCATTTCTTGCAAATCCAGCCAATCTCTGGAAACCTC<br>CACCGGCAACACGTACCTGAACTGGTATCTCCAGAAACCGGGTCAGA<br>GCCCGCAGCTGCTGATCTACCGTGTATCTAAGCGCTTCTCCGGCGTTC<br>CTGATCGTTTCAGCGGTTCTGGATCCGGCACCGACTTTACTCTGAAAA<br>TCAGCCGTGTGGAAGCTGAAGACGTTGGCGTCTACTATTGTCTGCAG<br>CTGACCCATGAACCATACACCTTCGGTCAAGGAACTAAACTGGAAAT<br>TAAACGTACGGTGGCTGCACCATCTGTCTTCATCTTCCCGCCATCTGA<br>TGAGCAGTTGAAATCTGGAACTGCCTCTGTTGTGTGCCTGCTGAATAA<br>CTTCTATCCCAGAGAGGCCAAAGTACAGTGGAAGGTGGATAACGCCC<br>TCCAATCGGGTAACTCCCAGGAGAGTGTCACAGAGCAGGACAGCAA<br>GGACAGCACCTACAGCCTCAGCAGCACCCTGACGCTGAGCAAAGCA<br>GACTACGAGAAACACAAAGTCTACGCCTGCGAAGTCACCCATCAGGG<br>CCTGAGCTCGCCCGTCACAAAGAGCTTCAACAGGGGAGAGTGT |
| 294 | 5D08 heavy chain | CAGGTGCAATTGGTTCAATCTGGTGCTGAAGTAAAAAAACCGGGCGC<br>TTCCGTTAAAGTGAGCTGCAAAGCATCTGGTTACACCTTCACTGACTA<br>TATCATGCACTGGGTTCGTCAGGCCCCGGGCCAGGGTCTGGAGTGGA<br>TGGGCTACATTAACCCATACAACGACGGTTCCAAATATACCGAGAAA<br>TTCCAGGGCCGCGTCACGATGACCAGCGACACTTCTATCTCCACCGC<br>GTACATGGAACTGTCTAGACTGCGTTCTGACGACACCGCTGTTTACTA<br>TTGTGCACGCGGTACCTACTACTACGGTTCTGAACTGTTTGATTACTG<br>GGGCCAAGGTACCACGGTGACCGTAAGCTCTGCTAGCACCAAGGGCC<br>CATCGGTCTTCCCCCTGGCACCCTCCTCCAAGAGCACCTCTGGGGGCA<br>CAGCGGCCCTGGGCTGCCTGGTCAAGGACTACTTCCCCGAACCGGTG<br>ACGGTGTCGTGGAACTCAGGCGCCCTGACCAGCGGCGTGCACACCTT<br>CCCGGCTGTCCTACAGTCCTCAGGACTCTACTCCCTCAGCAGCGTGGT<br>GACCGTGCCCTCCAGCAGCTTGGGCACCCAGACCTACATCTGCAACG<br>TGAATCACAAGCCCAGCAACACCAAGGTGGACAAGAAAGTTGAGCC<br>CAAATCTTGTGACAAAACTCACACATGCCCACCGTGCCCAGCACCTG<br>AAGCTGCAGGGGGACCGTCAGTCTTCCTCTTCCCCCCAAAACCCAAG<br>GACACCCTCATGATCTCCCGGACCCCTGAGGTCACATGCGTGGTGGT<br>GGACGTGAGCCACGAAGACCCTGAGGTCAAGTTCAACTGGTACGTGG<br>ACGGCGTGGAGGTGCATAATGCCAAGACAAAGCCGCGGGAGGAGCA<br>GTACAACAGCACGTACCGTGTGGTCAGCGTCCTCACCGTCCTGCACC<br>AGGACTGGCTGAATGGCAAGGAGTACAAGTGCAAGGTCTCCAACAA<br>AGCCCTCGGCGCCCCCATCGAGAAAACCATCTCCAAAGCCAAAGGGC<br>AGCCCCGAGAACCACAGGTGTACACCCTGCCCCCATCCCGGGATGAG<br>CTGACCAAGAACCAGGTCAGCCTGACCTGCCTGGTCAAAGGCTTCTA<br>TCCCAGCGACATCGCCGTGGAGTGGGAGAGCAATGGGCAGCCGGAG<br>AACAACTACAAGACCACGCCTCCCGTGCTGGACTCCGACGGCTCCTT<br>CTTCCTCTACAGCAAGCTCACCGTGGACAAGAGCAGGTGGCAGCAGG<br>GGAACGTCTTCTCATGCTCCGTGATGCATGAGGCTCTGCACAACCACT<br>ACACGCAGAAGAGCCTCTCCCTGTCTCCGGGTAAA |

TABLE 59-continued cDNA and amino acid sequences of affinity matured anti-CD19 clones in P329GLALA human IgG1 format

| SEQ ID NO: | Clone and Chain | Sequence |
|---|---|---|
| 295 | 5D08 light chain | DIVMTQTPLSLSVTPGQPASISCKSSQSLETSTGNTYLNWYLQKPGQSPQ LLIYRVSKRFSGVPDRFSGSGSGTDFTLKISRVEAEDVGVYYCLQLTHEP YTFGQGTKLEIKRTVAAPSVFIFPPSDEQLKSGTASVVCLLNNFYPREAK VQWKVDNALQSGNSQESVTEQDSKDSTYSLSSTLTLSKADYEKHKVYA CEVTHQGLSSPVTKSFNRGEC |
| 296 | 5D08 heavy chain | QVQLVQSGAEVKKPGASVKVSCKASGYTFTDYIMHWVRQAPGQGLEW MGYINPYNDGSKYTEKFQGRVTMTSDTSISTAYMELSRLRSDDTAVYYC ARGTYYYGSELFDYWGQGTTVTVSSASTKGPSVFPLAPSSKSTSGGTAA LGCLVKDYFPEPVTVSWNSGALTSGVHTFPAVLQSSGLYSLSSVVTVPSS SLGTQTYICNVNHKPSNTKVDKKVEPKSCDKTHTCPPCPAPEAAGGPSV FLFPPKPKDTLMISRTPEVTCVVVDVSHEDPEVKFNWYVDGVEVHNAKT KPREEQYNSTYRVVSVLTVLHQDWLNGKEYKCKVSNKALGAPIEKTISK AKGQPREPQVYTLPPSRDELTKNQVSLTCLVKGFYPSDIAVEWESNGQP ENNYKTTPPVLDSDGSFFLYSKLTVDKSRWQQGNVFSCSVMHEALHNH YTQKSLSLSPGK |
| 297 | 5B08 light chain | GATATTGTTATGACTCAAACTCCACTGTCTCTGTCCGTGACCCCGGGT CAGCCAGCGAGCATTTCTTGCAAATCCAGCCAATCTCTGGAAACCTC CACCGGCAACACGTACCTGAACTGGTATCTCCAGAAACCGGGTCAGA GCCCGCAGCTGCTGATCTACCGTGTATCTAAGCGCTTCTCCGGCGTTC CTGATCGTTTCAGCGGTTCTGGATCCGGCACCGACTTTACTCTGAAAA TCAGCCGTGTGGAAGCTGAAGACGTTGGCGTCTACTATTGTCTGCAG CTGGATTCTTACCCAAACACCTTCGGTCAAGGAACTAAACTGGAAAT TAAACGTACGGTGGCTGCACCATCTGTCTTCATCTTCCCGCCATCTGA TGAGCAGTTGAAATCTGGAACTGCCTCTGTTGTGTGCCTGCTGAATAA CTTCTATCCCAGAGAGGCCAAAGTACAGTGGAAGGTGGATAACGCCC TCCAATCGGGTAACTCCCAGGAGAGTGTCACAGAGCAGGACAGCAA GGACAGCACCTACAGCCTCAGCAGCACCCTGACGCTGAGCAAAGCA GACTACGAGAAACACAAAGTCTACGCCTGCGAAGTCACCCATCAGGG CCTGAGCTCGCCCGTCACAAAGAGCTTCAACAGGGGAGAGTGT |
| 298 | 5B08 heavy chain | CAGGTGCAATTGGTTCAATCTGGTGCTGAAGTAAAAAAACCGGGCGC TTCCGTTAAAGTGAGCTGCAAAGCATCTGGTTACACCTTCACTGACTA TATCATGCACTGGGTTCGTCAGGCCCCGGGCCAGGGTCTGGAGTGGA TGGGCTACATTAACCCATACAACGACGGTTCCAAATATACCGAGAAA TTCCAGGGCCGCGTCACGATGACCAGCGACACTTCTATCTCCACCGC GTACATGGAACTGTCTAGACTGCGTTCTGACGACACCGCTGTTTACTA TTGTGCACGCGGTACCTACTACTACGGTCCACAGCTGTTTGATTACTG GGGCCAAGGTACCACGGTGACCGTAAGCTCTGCTAGCACCAAGGGCC CATCGGTCTTCCCCCTGGCACCCTCCTCCAAGAGCACCTCTGGGGGCA CAGCGGCCCTGGGCTGCCTGGTCAAGGACTACTTCCCCGAACCGGTG ACGGTGTCGTGGAACTCAGGCGCCCTGACCAGCGGCGTGCACACCTT CCCGGCTGTCCTACAGTCCTCAGGACTCTACTCCCTCAGCAGCGTGGT GACCGTGCCCTCCAGCAGCTTGGGCACCCAGACCTACATCTGCAACG TGAATCACAAGCCCAGCAACACCAAGGTGGACAAGAAAGTTGAGCC CAAATCTTGTGACAAAACTCACACATGCCCACCGTGCCCAGCACCTG AAGCTGCAGGGGGACCGTCAGTCTTCCTCTTCCCCCCAAAACCCAAG GACACCCTCATGATCTCCCGGACCCCTGAGGTCACATGCGTGGTGGT GGACGTGAGCCACGAAGACCCTGAGGTCAAGTTCAACTGGTACGTGG ACGGCGTGGAGGTGCATAATGCCAAGACAAAGCCGCGGGAGGAGCA GTACAACAGCACGTACCGTGTGGTCAGCGTCCTCACCGTCCTGCACC AGGACTGGCTGAATGGCAAGGAGTACAAGTGCAAGGTCTCCAACAA AGCCCTCGGCGCCCCCATCGAGAAAACCATCTCCAAAGCCAAAGGGC AGCCCCGAGAACCACAGGTGTACACCCTGCCCCCATCCCGGGATGAG CTGACCAAGAACCAGGTCAGCCTGACCTGCCTGGTCAAAGGCTTCTA TCCCAGCGACATCGCCGTGGAGTGGGAGAGCAATGGGCAGCCGGAG AACAACTACAAGACCACGCCTCCCGTGCTGGACTCCGACGGCTCCTT CTTCCTCTACAGCAAGCTCACCGTGGACAAGAGCAGGTGGCAGCAGG GGAACGTCTTCTCATGCTCCGTGATGCATGAGGCTCTGCACAACCACT ACACGCAGAAGAGCCTCTCCCTGTCTCCGGGTAAA |
| 299 | 5B08 light chain | DIVMTQTPLSLSVTPGQPASISCKSSQSLETSTGNTYLNWYLQKPGQSPQ LLIYRVSKRFSGVPDRFSGSGSGTDFTLKISRVEAEDVGVYYCLQLDSYP NTFGQGTKLEIKRTVAAPSVFIFPPSDEQLKSGTASVVCLLNNFYPREAK VQWKVDNALQSGNSQESVTEQDSKDSTYSLSSTLTLSKADYEKHKVYA CEVTHQGLSSPVTKSFNRGEC |
| 300 | 5B08 heavy chain | QVQLVQSGAEVKKPGASVKVSCKASGYTFTDYIMHWVRQAPGQGLEW MGYINPYNDGSKYTEKFQGRVTMTSDTSISTAYMELSRLRSDDTAVYYC ARGTYYYGPQLFDYWGQGTTVTVSSASTKGPSVFPLAPSSKSTSGGTAA LGCLVKDYFPEPVTVSWNSGALTSGVHTFPAVLQSSGLYSLSSVVTVPSS SLGTQTYICNVNHKPSNTKVDKKVEPKSCDKTHTCPPCPAPEAAGGPSV |

TABLE 59-continued cDNA and amino acid sequences of affinity matured anti-CD19 clones in P329GLALA human IgG1 format

| SEQ ID NO: | Clone and Chain | Sequence |
|---|---|---|
| | | FLFPPKPKDTLMISRTPEVTCVVVDVSHEDPEVKFNWYVDGVEVHNAKT KPREEQYNSTYRVVSVLTVLHQDWLNGKEYKCKVSNKALGAPIEKTISK AKGQPREPQVYTLPPSRDELTKNQVSLTCLVKGFYPSDIAVEWESNGQP ENNYKTTPPVLDSDGSFFLYSKLTVDKSRWQQGNVFSCSVMHEALHNH YTQKSLSLSPGK |
| 301 | 5H09 light chain | GATATTGTTATGACTCAAACTCCACTGTCTCTGTCCGTGACCCCGGGT CAGCCAGCGAGCATTTCTTGCAAATCCAGCCAATCTCTGGAATCTTCC ACCGGCAACACGTACCTGAACTGGTATCTCCAGAAACCGGGTCAGAG CCCGCAGCTGCTGATCTACCGTGTATCTAAGCGCTTCTCCGGCGTTCC TGATCGTTTCAGCGGTTCTGGATCCGGCACCGACTTTACTCTGAAAAT CAGCCGTGTGGAAGCTGAAGACGTTGGCGTCTACTATTGTCTGCAGC TGATCGATTACCCAGTTACCTTCGGTCAAGGAACTAAACTGGAAATT AAACGTACGGTGGCTGCACCATCTGTCTTCATCTTCCCGCCATCTGAT GAGCAGTTGAAATCTGGAACTGCCTCTGTTGTGTGCCTGCTGAATAA CTTCTATCCCAGAGAGGCCAAAGTACAGTGGAAGGTGGATAACGCCC TCCAATCGGGTAACTCCCAGGAGAGTGTCACAGAGCAGGACAGCAA GGACAGCACCTACAGCCTCAGCAGCACCCTGACGCTGAGCAAAGCA GACTACGAGAAACACAAAGTCTACGCCTGCGAAGTCACCCATCAGGG CCTGAGCTCGCCCGTCACAAAGAGCTTCAACAGGGGAGAGTGT |
| 302 | 5H09 heavy chain | CAGGTGCAATTGGTTCAATCTGGTGCTGAAGTAAAAAAACCGGGCGC TTCCGTTAAAGTGAGCTGCAAAGCATCTGGTTACACCTTCACTGACTA TATCATGCACTGGGTTCGTCAGGCCCCGGGCCAGGGTCTGGAGTGGA TGGGCTACATTAACCCATACAACGACGGTTCCAAATATACCGAGAAA TTCCAGGGCCGCGTCACGATGACCAGCGACACTTCTATCTCCACCGC GTACATGGAACTGTCTAGACTGCGTTCTGACGACACCGCTGTTTACTA TTGTGCACGCGGTACCTACTACTACGGTTCTGCACTGTTTGATTACTG GGGCCAAGGTACCACGGTGACCGTAAGCTCTGCTAGCACCAAGGGCC CATCGGTCTTCCCCCTGGCACCCTCCTCCAAGAGCACCTCTGGGGGCA CAGCGGCCCTGGGCTGCCTGGTCAAGGACTACTTCCCCGAACCGGTG ACGGTGTCGTGGAACTCAGGCGCCCTGACCAGCGGCGTGCACACCTT CCCGGCTGTCCTACAGTCCTCAGGACTCTACTCCCTCAGCAGCGTGGT GACCGTGCCCTCCAGCAGCTTGGGCACCCAGACCTACATCTGCAACG TGAATCACAAGCCCAGCAACACCAAGGTGGACAAGAAAGTTGAGCC CAAATCTTGTGACAAAACTCACACATGCCCACCGTGCCCAGCACCTG AAGCTGCAGGGGGACCGTCAGTCTTCCTCTTCCCCCCAAAACCCAAG GACACCCTCATGATCTCCCGGACCCCTGAGGTCACATGCGTGGTGGT GGACGTGAGCCACGAAGACCCTGAGGTCAAGTTCAACTGGTACGTGG ACGGCGTGGAGGTGCATAATGCCAAGACAAAGCCGCGGGAGGAGCA GTACAACAGCACGTACCGTGTGGTCAGCGTCCTCACCGTCCTGCACC AGGACTGGCTGAATGGCAAGGAGTACAAGTGCAAGGTCTCCAACAA AGCCCTCGGCGCCCCCATCGAGAAAACCATCTCCAAAGCCAAGGGC AGCCCCGAGAACCACAGGTGTACACCCTGCCCCCATCCCGGGATGAG CTGACCAAGAACCAGGTCAGCCTGACCTGCCTGGTCAAAGGCTTCTA TCCCAGCGACATCGCCGTGGAGTGGGAGAGCAATGGGCAGCCGGAG AACAACTACAAGACCACGCCTCCCGTGCTGGACTCCGACGGCTCCTT CTTCCTCTACAGCAAGCTCACCGTGGACAAGAGCAGGTGGCAGCAGG GGAACGTCTTCTCATGCTCCGTGATGCATGAGGCTCTGCACAACCACT ACACGCAGAAGAGCCTCTCCCTGTCTCCGGGTAAA |
| 303 | 5H09 light chain | DIVMTQTPLSLSVTPGQPASISCKSSQSLESSTGNTYLNWYLQKPGQSPQ LLIYRVSKRFSGVPDRFSGSGSGTDFTLKISRVEAEDVGVYYCLQLIDYP VTFGQGTKLEIKRTVAAPSVFIFPPSDEQLKSGTASVVCLLNNFYPREAK VQWKVDNALQSGNSQESVTEQDSKDSTYSLSSTLTLSKADYEKHKVYA CEVTHQGLSSPVTKSFNRGEC |
| 304 | 5H09 heavy chain | QVQLVQSGAEVKKPGASVKVSCKASGYTFTDYIMHWVRQAPGQGLEW MGYINPYNDGSKYTEKFQGRVTMTSDTSISTAYMELSRLRSDDTAVYYC ARGTYYYGSALFDYWGQGTTVTVSSASTKGPSVFPLAPSSKSTSGGTAA LGCLVKDYFPEPVTVSWNSGALTSGVHTFPAVLQSSGLYSLSSVVTVPSS SLGTQTYICNVNHKPSNTKVDKKVEPKSCDKTHTCPPCPAPEAAGGPSV FLFPPKPKDTLMISRTPEVTCVVVDVSHEDPEVKFNWYVDGVEVHNAKT KPREEQYNSTYRVVSVLTVLHQDWLNGKEYKCKVSNKALGAPIEKTISK AKGQPREPQVYTLPPSRDELTKNQVSLTCLVKGFYPSDIAVEWESNGQP ENNYKTTPPVLDSDGSFFLYSKLTVDKSRWQQGNVFSCSVMHEALHNH YTQKSLSLSPGK |

7.2.2.2 Affinity Determination of Selected Antibodies by SPR

For the exact determination of the affinities by SPR, the selected anti-CD19 antibodies were produced by co-transfecting HEK293-EBNA cells with the mammalian expression vectors using polyethylenimine. The cells were transfected with the corresponding expression vectors in a 1:1 ratio ("vector heavy chain":"vector light chain") according to the standard procedure. 7 days after transfection, the antibody titer in the supernatant was measured and all titers were equilibrated to 10 μg/ml.

The Affinity ($K_D$) of the parental antibody 8B8 as well as it derivatives was measured by SPR using a ProteOn XPR36 instrument (Biorad) at 25° C. 7000 RU of polyclonal anti-human Fab antibody were immobilized on all 6 channels of a GLM chip by Amine coupling (NaAcetate pH4.5, 25 ul/min, 240s) (vertical orientation). Each antibody-containing HEK supernatant was filtered, diluted with PBST (10 mM phosphate, 150 mM sodium chloride pH 7.4, 0.005% Tween 20) to a concentration of 10 ug/ml, and then injected at a for 360s at 25 μl/minute to achieve immobilization levels between 500 and 800 response units (RU) in vertical orientation. Injection of monomeric CD19-Fc: For one-shot kinetics measurements, injection direction was changed to horizontal orientation, three-fold dilution series of purified monomeric CD19-Fc (varying concentration ranges between 150 and 6 nM) were injected simultaneously at 50 μl/min along separate channels 1-4, with association times of 180s, and dissociation times of 300s. A human IgG Fc fragment (150 nM) was injected in channel 5 as a negative control for specific binding to monomeric CD19-Fc. Buffer (PBST) was injected along the sixth channel to provide an "in-line" blank for referencing. An overview of the respective sensorgrams is shown in FIGS. 33A-33H. Regeneration was performed by two pulses of 10 mM glycine pH 1.5 and 50 mM NaOH for 30s at 90 ul/min (vertical orientation). Association rate constants ($k_{on}$) and dissociation rate constants ($k_{off}$) were calculated using a simple one-to-one Langmuir binding model in ProteOn Manager v3.1 software by simultaneously fitting the association and dissociation sensorgrams. The equilibrium dissociation constant ($K_D$) was calculated as the ratio $k_{off}/k_{on}$. A summary of the kinetic and thermodynamic data is shown in Table 60. The dissociation constant of all affinity-matured clones was improved compared to their parental clone 8B8.

TABLE 60

Summary of the kinetic and thermodynamic data for the interaction between anti-CD19 huIgG1 and human CD19

| clone | ka (1/Ms) | kd (1/s) | KD (M) |
|---|---|---|---|
| Parental 8B8 | 5.66E+4 | 1.34E−4 | 2.36E−9 |
| 5H09 | 7.91E+4 | 1.50E−5 | 1.89E−10 |
| 7H07 | 7.45E+4 | 5.57E−5 | 7.47E−10 |
| 2B03 | 6.02E+4 | 5.00E−5 | 8.31E−10 |
| 2B11 | 6.34E+4 | 3.14E−5 | 4.95E−10 |
| 5A07 | 6.98E+4 | 3.07E−5 | 4.40E−10 |
| 5B08 | 6.81E+4 | 5.26E−5 | 7.72E−10 |
| 5D08 | 8.88E+4 | 8.44E−5 | 9.51E−10 |

7.2.2.3 Preparation and Purification of Anti-CD19 IgG1 P329G LALA

The selected anti-CD19 antibodies were produced by co-transfecting HEK293-EBNA cells with the mammalian expression vectors using polyethylenimine. The cells were transfected with the corresponding expression vectors in a 1:1 ratio ("vector heavy chain":"vector light chain").

For the production in 500 mL shake flasks, 400 million HEK293 EBNA cells were seeded 24 hours before transfection. Before the transfection, cells were centrifuged for 5 minutes at 210×g, and the supernatant was replaced by pre-warmed CD CHO medium. Expression vectors (200 μg of total DNA) were mixed in 20 mL CD CHO medium. After addition of 540 μL PEI, the solution was vortexed for 15 seconds and incubated for 10 minutes at room temperature. Afterwards, cells were mixed with the DNA/PEI solution, transferred to a 500 mL shake flask and incubated for 3 hours at 37° C. in an incubator with a 5% CO2 atmosphere. After the incubation, 160 mL of F17 medium was added and cells were cultured for 24 hours. One day after transfection 1 mM valproic acid and 7% Feed with supplements were added. After culturing for 7 days, the supernatant was collected by centrifugation for 15 minutes at 210×g. The solution was sterile filtered (0.22 μm filter), supplemented with sodium azide to a final concentration of 0.01% (w/v), and kept at 4° C.

Purification of antibody molecules from cell culture supernatants was carried out by affinity chromatography using Protein A as described above for purification of antigen Fc fusions. The protein was concentrated and filtered prior to loading on a HILOAD® Superdex 200 column (GE Healthcare) equilibrated with 20 mM Histidine, 140 mM NaCl solution of pH 6.0.

The protein concentration of purified antibodies was determined by measuring the OD at 280 nm, using the molar extinction coefficient calculated on the basis of the amino acid sequence. Purity and molecular weight of the antibodies were analyzed by CE-SDS in the presence and absence of a reducing agent (Invitrogen, USA) using a LabChipGXII (Caliper). The aggregate content of antibody samples was analyzed using a TSKGEL® G3000 SW XL analytical size-exclusion column (Tosoh) equilibrated in a 25 mM $K_2HPO_4$, 125 mM NaCl, 200 mM L-Arginine Monohydrocloride, 0.02% (w/v) $NaN_3$, pH 6.7 running buffer at 25° C. (Table 61).

TABLE 61

Biochemical analysis of anti-CD19 P329G LALA IgG1 clones

| Clone | Yield [mg/l] | Monomer [%] | CE-SDS (non red) |
|---|---|---|---|
| Parental 8B8 | 25.3 | 100 | 99.1 |
| 2B11 | 35.4 | 100 | 98.4 |
| 7H07 | 89.8 | 100 | 99.4 |
| 2B03 | 182 | 100 | 100 |
| 5A07 | 90.2 | 100 | 99.4 |
| 5D08 | 90.2 | 100 | 99.3 |
| 5B08 | 24.1 | 99.6 | 100 |
| 5H09 | 29.9 | 100 | 98.1 |

For the preparation of bispecific constructs clone 2B11 was chosen because it lacks the three deamidation hotspots.

The DNA sequence encoding part of the ectodomain (amino acid 71-254 and 71-248) of human 4-1BB ligand was synthesized according to the P41273 sequence of Uniprot database.

7.2.3 Preparation of Monovalent CD19 (8B8-2B11) Targeted 4-1BB Ligand (71-254) Trimer-Containing Fc (kih) Fusion Antigen Binding Molecule with Crossed CH1-CL Domains with Charged Residues (Construct 4.1)

The construct 4.1 was prepared as described for construct 3.1 (FIG. 30A), but using the variable region of heavy and light chain DNA sequences encoding a binder specific for CD19, clone 8B8-2B11.

Table 62 shows the cDNA and amino acid sequences of the monovalent CD19(8B8-2B11) targeted split trimeric 4-1BB ligand (71-254) Fc (kih) fusion antigen binding molecule with crossed CH-CL and charged residues (construct 4.1).

TABLE 62 cDNA and amino acid sequences of monovalent CD19 (8B8-2B11) targeted split trimeric 4-1BB ligand (71-254) Fc (kih) fusion containing CH—CL cross with charged residues (construct 4.1).

| SEQ ID NO: | Description | Sequence |
|---|---|---|
| 129 | Nucleotide sequence Dimeric hu 4-1BBL (71-254)-CL* Fc knob chain | see Table 3 |
| 130 | Nucleotide sequence Monomeric hu 4-1BBL (71-254)-CH1* | see Table 3 |
| 305 | Nucleotide sequence anti-CD19(8B8-2B11) Fc hole chain | CAGGTGCAATTGGTTCAATCTGGTGCTGAAGTAAAAAA ACCGGGCGCTTCCGTTAAAGTGAGCTGCAAAGCATCTGG TTACACCTTCACTGACTATATCATGCACTGGGTTCGTCA GGCCCCGGGCCAGGGTCTGGAGTGGATGGGCTACATTA ACCCATACAACGACGGTTCCAAATATACCGAGAAATTC CAGGGCCGCGTCACGATGACCAGCGACACTTCTATCTCC ACCGCGTACATGGAACTGTCTAGACTGCGTTCTGACGAC ACCGCTGTTTACTATTGTGCACGCGGTACCTACTACTAC GGTCCACAGCTGTTTGATTACTGGGGCCAAGGTACCACG GTGACCGTAAGCTCTGCTAGCACCAAGGGCCCCTCCGTG TTCCCCCTGGCCCCCAGCAGCAAGAGCACCAGCGGCGG CACAGCCGCTCTGGGCTGCCTGGTCAAGGACTACTTCCC CGAGCCCGTGACCGTGTCCTGGAACAGCGGAGCCCTGA CCTCCGGCGTGCACACCTTCCCCGCCGTGCTGCAGAGTT CTGGCCTGTATAGCCTGAGCAGCGTGGTCACCGTGCCTT CTAGCAGCCTGGGCACCCAGACCTACATCTGCAACGTG AACCACAAGCCCAGCAACACCAAGGTGGACAAGAAGGT GGAGCCCAAGAGCTGCGACAAAACTCACACATGCCCAC CGTGCCCAGCACCTGAAGCTGCAGGGGGACCGTCAGTC TTCCTCTTCCCCCCAAAACCCAAGGACACCCTCATGATC TCCCGGACCCCTGAGGTCACATGCGTGGTGGTGGACGTG AGCCACGAAGACCCTGAGGTCAAGTTCAACTGGTACGT GGACGGCGTGGAGGTGCATAATGCCAAGACAAAGCCGC GGGAGGAGCAGTACAACAGCACGTACCGTGTGGTCAGC GTCCTCACCGTCCTGCACCAGGACTGGCTGAATGGCAAG GAGTACAAGTGCAAGGTCTCCAACAAAGCCCTCGGCGC CCCCATCGAGAAAACCATCTCCAAAGCCAAAGGGCAGC CCCGAGAACCACAGGTGTGCACCCTGCCCCCATCCCGG GATGAGCTGACCAAGAACCAGGTCAGCCTCTCGTGCGC AGTCAAAGGCTTCTATCCCAGCGACATCGCCGTGGAGTG GGAGAGCAATGGGCAGCCGGAGAACAACTACAAGACC ACGCCTCCCGTGCTGGACTCCGACGGCTCCTTCTTCCTC GTGAGCAAGCTCACCGTGGACAAGAGCAGGTGGCAGCA GGGGAACGTCTTCTCATGCTCCGTGATGCATGAGGCTCT GCACAACCACTACACGCAGAAGAGCCTCTCCCTGTCTCC GGGTAAA |
| 277 | Nucleotide sequence anti-CD19 (8B8-2B11) light chain | see Table 59 |
| 115 | Dimeric hu 4-1BBL (71-254)-CL* Fc knob chain | see Table 3 |
| 116 | Monomeric hu 4-1BBL (71-254)-CH1* | see Table 3 |
| 306 | anti-CD19 (8B8-2B11) Fc hole chain | QVQLVQSGAEVKKPGASVKVSCKASGYTFTDYIMHWVRQ APGQGLEWMGYINPYNDGSKYTEKFQGRVTMTSDTSISTA YMELSRLRSDDTAVYYCARGTYYYGPQLFDYWGQGTTVT VSSASTKGPSVFPLAPSSKSTSGGTAALGCLVKDYFPEPVT VSWNSGALTSGVHTFPAVLQSSGLYSLSSVVTVPSSSLGTQ TYICNVNHKPSNTKVDKKVEPKSCDKTHTCPPCPAPEAAG GPSVFLFPPKPKDTLMISRTPEVTCVVVDVSHEDPEVKFNW YVDGVEVHNAKTKPREEQYNSTYRVVSVLTVLHQDWLN GKEYKCKVSNKALGAPIEKTISKAKGQPREPQVCTLPPSRD ELTKNQVSLSCAVKGFYPSDIAVEWESNGQPENNYKTTPP |

TABLE 62-continued cDNA and amino acid sequences of monovalent CD19 (8B8-2B11) targeted split trimeric 4-1BB ligand (71-254) Fc (kih) fusion containing CH—CL cross with charged residues (construct 4.1).

| SEQ ID NO: | Description | Sequence |
|---|---|---|
|  |  | VLDSDGSFFLVSKLTVDKSRWQQGNVFSCSVMHEALHNHYTQKSLSLSPGK |
| 206 | anti-CD19 (8B8-2b11) light chain | see Table 59 |

*for charged residues 7.2.4 Preparation of Monovalent CD19(8B8-2B11) Targeted 4-1BB Ligand (71-254) Trimer-Containing Fc (kih) Fusion Antigen Binding Molecule with Crossed CH1-CL Domains without Charged Residues (Construct 4.2)

The construct 4.2 was prepared as described for construct 3.2 (FIG. 30B), but using the variable region of heavy and light chain DNA sequences encoding a binder specific for CD19, clone 8B8-2B11.

Table 63 shows the cDNA and amino acid sequences of the monovalent CD19(8B8-2B11) targeted split trimeric 4-1BB ligand (71-254) Fc (kih) fusion antigen binding molecule containing crossed CH-CL cross without charged residues (construct 4.2).

TABLE 63 cDNA and amino acid sequences of monovalent CD19(8B8-2B11) targeted split trimeric 4-1BB ligand (71-254) Fc (kih) fusion containing CH—CL cross without charged residues (construct 4.2).

| SEQ ID NO: | Description | Sequence |
|---|---|---|
| 165 | Nucleotide sequence dimeric ligand (71-254) - CL Fc knob chain | see Table 22 |
| 166 | Nucleotide sequence monomeric hu 4-1BBL (71-254) - CH1 | see Table 22 |

TABLE 63-continued cDNA and amino acid sequences of monovalent CD19(8B8-2B11) targeted split trimeric 4-1BB ligand (71-254) Fc (kih) fusion containing CH—CL cross without charged residues (construct 4.2).

| SEQ ID NO: | Description | Sequence |
|---|---|---|
| 305 | Nucleotide sequence anti-CD19(8B8-2B11) Fc hole chain | see Table 62 |
| 277 | Nucleotide sequence anti-CD19(8B8-2B11) light chain | see Table 59 |
| 117 | Dimeric ligand (71-254) - CL Fc knob chain | see Table 22 |
| 118 | Monomeric ligand (71-254) - CH1 | see Table 22 |
| 306 | anti-CD19(8B8-2B11) Fc hole chain | see Table 62 |
| 279 | anti-CD19(8B8-018) light chain | see Table 59 |

7.2.5 Preparation of Bivalent CD19(8B8-2B11) Targeted 4-1BB Ligand (71-254) Trimer-Containing Fc (kih) Fusion Antigen Binding (Construct 4.3)

The construct 4.3 was prepared as described for construct 3.3 (FIG. 30C), but using the variable region of heavy and light chain DNA sequences encoding a binder specific for CD19, clone 8B8-2B11.

Table 64 shows the cDNA and amino acid sequences of the bivalent CD19 (8B8-2B11) targeted split trimeric 4-1BB ligand (71-254) Fc (kih) fusion antigen binding molecule (construct 4.3).

TABLE 64 cDNA and amino acid sequences of bivalent CD19 (8B8-2B11) targeted split trimeric 4-1BB ligand Fc (kih) PGLALA fusion (construct 4.3)

| SEQ ID NO: | Description | Sequence |
|---|---|---|
| 307 | Nucleotide sequence anti-CD19 (8B8-2B11) Fc hole dimeric ligand chain | CAGGTGCAATTGGTTCAATCTGGTGCTGAAGTAAAAAAACCGGGCGCTTCCGTTAAAGTGAGCTGCAAAGCATCTGGTTACACCTTCACTGACTATATCATGCACTGGGTTCGTCAGGCCCCGGGCCAGGGTCTGGAGTGGATGGGCTACATTAACCCATACAACGACGGTTCCAAATATACCGAGAAATTCCAGGGCCGCGTCACGATGACCAGCGACACTTCTATCTCCACCGCGTACATGGAACTGTCTAGACTGCGTTCTGACGACACCGCTGTTTACTATTGTGCACGCGGTACCTACTACTACGGTCCACAGCTGTTTGATTACTGGGGCCAAGGTACCACGGTGACCGTAAGCTCTGCTAGCACCAAGGGCCCCTCCGTGTTCCCCCTGGCCCCCAGCAGCAAGAGCACCAGCGGCGGCACAGCCGCTCTGGGCTGCCTGGTCAAGGACTACTTCCCCGAGCCCGTGACCGTGTCCTGGAACAGCGGAGCCCTGACCTCCGGCGTGCACACCTTCCCCGCCGTGCTGCAGAGTTCTGGCCT |

TABLE 64-continued cDNA and amino acid sequences of bivalent CD19 (8B8-2B11) targeted split trimeric 4-1BB ligand Fc (kih) PGLALA fusion (construct 4.3)

| SEQ ID NO: | Description | Sequence |
|---|---|---|
| | | GTATAGCCTGAGCAGCGTGGTCACCGTGCCTTCTAGCAGCC<br>TGGGCACCCAGACCTACATCTGCAACGTGAACCACAAGCCC<br>AGCAACACCAAGGTGGACAAGAAGGTGGAGCCCAAGAGCT<br>GCGACAAAACTCACACATGCCCACCGTGCCCAGCACCTGAA<br>GCTGCAGGGGGACCGTCAGTCTTCCTCTTCCCCCCAAAACC<br>CAAGGACACCCTCATGATCTCCCGGACCCCTGAGGTCACAT<br>GCGTGGTGGTGGACGTGAGCCACGAAGACCCTGAGGTCAA<br>GTTCAACTGGTACGTGGACGGCGTGGAGGTGCATAATGCCA<br>AGACAAAGCCGCGGGAGGAGCAGTACAACAGCACGTACCG<br>TGTGGTCAGCGTCCTCACCGTCCTGCACCAGGACTGGCTGA<br>ATGGCAAGGAGTACAAGTGCAAGGTCTCCAACAAAGCCCTC<br>GGCGCCCCCATCGAGAAAACCATCTCCAAAGCCAAAGGGC<br>AGCCCCGAGAACCACAGGTGTGCACCCTGCCCCCATCCCG<br>GGATGAGCTGACCAAGAACCAGGTCAGCCTCTCGTGCGCA<br>GTCAAAGGCTTCTATCCCAGCGACATCGCCGTGGAGTGGGA<br>GAGCAATGGGCAGCCGGAGAACAACTACAAGACCACGCCT<br>CCCGTGCTGGACTCCGACGGCTCCTTCTTCCTCGTGAGCAA<br>GCTCACCGTGGACAAGAGCAGGTGGCAGCAGGGGAACGTC<br>TTCTCATGCTCCGTGATGCATGAGGCTCTGCACAACCACTA<br>CACGCAGAAGAGCCTCTCCCTGTCTCCGGGTGGAGGCGGC<br>GGAAGCGGAGGAGGAGGATCCAGAGAGGGCCCTGAGCTG<br>AGCCCCGATGATCCTGCTGGACTGCTGGACCTGCGGCAGG<br>GCATGTTTGCTCAGCTGGTGGCCCAGAACGTGCTGCTGATC<br>GATGGCCCCCTGTCCTGGTACAGCGATCCTGGACTGGCTG<br>GCGTGTCACTGACAGGCGGCCTGAGCTACAAAGAGGACAC<br>CAAAGAACTGGTGGTGGCCAAGGCCGGCGTGTACTACGTG<br>TTCTTTCAGCTGGAACTGCGGAGAGTGGTGGCCGGCGAAG<br>GATCTGGCTCTGTGTCTCTGGCCCTGCATCTGCAGCCTCTG<br>AGAAGCGCTGCTGGCGCTGCAGCTCTGGCACTGACAGTGG<br>ATCTGCCTCCTGCCAGCTCCGAGGCCCGGAATAGCGCATTT<br>GGGTTTCAAGGCAGGCTGCTGCACCTGTCTGCCGGCCAGA<br>GGCTGGAGTGCATCTGCACACAGAGGCCAGGGCTAGACA<br>CGCCTGGCAGCTGACACAGGGCGCTACAGTGCTGGGCCTG<br>TTCAGAGTGACCCCCGAGATTCCAGCCGGCCTGCCTTCTCC<br>AAGAAGCGAAGGCGGAGGCGGATCTGGCGGCGGAGGATC<br>TAGAGAGGGACCCGAACTGTCCCCTGACGATCCAGCCGGG<br>CTGCTGGATCTGAGACAGGGAATGTTCGCCCAGCTGGTGG<br>CTCAGAATGTGCTGCTGATTGACGGACCTCTGAGCTGGTAC<br>TCCGACCCAGGGCTGGCAGGGGTGTCCCTGACTGGGGGAC<br>TGTCCTACAAAGAAGATACAAAAGAACTGGTGGTGGCTAAA<br>GCTGGGGTGTACTATGTGTTTTTTCAGCTGGAACTGAGGCG<br>GGTGGTGGCTGGGGAGGGCTCAGGATCTGTGTCCCTGGCT<br>CTGCATCTGCAGCCACTGCGCTCTGCTGCTGGCGCAGCTG<br>CACTGGCTCTGACTGTGGACCTGCCACCAGCCTCTAGCGAG<br>GCCAGAAACAGCGCCTTCGGGTTCCAAGGACGCCTGCTGC<br>ATCTGAGCGCCGGACAGCGCCTGGGAGTGCATCTGCATAC<br>TGAAGCCAGAGCCCGGCATGCTTGGCAGCTGACTCAGGGG<br>GCAACTGTGCTGGGACTGTTTCGCGTGACACCTGAGATCCC<br>TGCCGGACTGCCAAGCCCTAGATCAGAA |
| 308 | Nucleotide sequence anti-CD19 (8B8-2B11) Fc knob monomeric ligand | CAGGTGCAATTGGTTCAATCTGGTGCTGAAGTAAAAAA<br>ACCGGGCGCTTCCGTTAAAGTGAGCTGCAAAGCATCTGG<br>TTACACCTTCACTGACTATATCATGCACTGGGTTCGTCA<br>GGCCCCGGGCCAGGGTCTGGAGTGGATGGGCTACATTA<br>ACCCATACAACGACGGTTCCAAATATACCGAGAAATTC<br>CAGGGCCGCGTCACGATGACCAGCGACACTTCTATCTCC<br>ACCGCGTACATGGAACTGTCTAGACTGCGTTCTGACGAC<br>ACCGCTGTTTACTATTGTGCACGCGGTACCTACTACTAC<br>GGTCCACAGCTGTTTGATTACTGGGGCCAAGGTACCACG<br>GTGACCGTAAGCTCTGCTAGCACCAAGGGCCCATCGGTCT<br>TCCCCCTGGCACCCTCCTCCAAGAGCACCTCTGGGGGCAC<br>AGCGGCCCTGGGCTGCCTGGTCAAGGACTACTTCCCCGAA<br>CCGGTGACGGTGTCGTGGAACTCAGGCGCCCTGACCAGCG<br>GCGTGCACACCTTCCCGGCTGTCCTACAGTCCTCAGGACTC<br>TACTCCCTCAGCAGCGTGGTGACCGTGCCCTCCAGCAGCTT<br>GGGCACCCAGACCTACATCTGCAACGTGAATCACAAGCCCA<br>GCAACACCAAGGTGGACAAGAAAGTTGAGCCCAAATCTTGT<br>GACAAAACTCACACATGCCCACCGTGCCCAGCACCTGAAGC<br>TGCAGGGGACCGTCAGTCTTCCTCTTCCCCCCAAAACCCA<br>AGGACACCCTCATGATCTCCCGGACCCCTGAGGTCACATGC<br>GTGGTGGTGGACGTGAGCCACGAAGACCCTGAGGTCAAGT<br>TCAACTGGTACGTGGACGGCGTGGAGGTGCATAATGCCAA<br>GACAAAGCCGCGGGAGGAGCAGTACAACAGCACGTACCGT<br>GTGGTCAGCGTCCTCACCGTCCTGCACCAGGACTGGCTGA<br>ATGGCAAGGAGTACAAGTGCAAGGTCTCCAACAAAGCCCTC |

TABLE 64-continued cDNA and amino acid sequences of bivalent CD19 (8B8-2B11) targeted split trimeric 4-1BB ligand Fc (kih) PGLALA fusion (construct 4.3)

| SEQ ID NO: | Description | Sequence |
|---|---|---|
| | | *GGCGCCCCCATCGAGAAAACCATCTCCAAAGCCAAAGGGC AGCCCCGAGAACCACAGGTGTACACCCTGCCCCCCTGCAG AGATGAGCTGACCAAGAACCAGGTGTCCCTGTGGTGTCTGG TCAAGGGCTTCTACCCCAGCGATATCGCCGTGGAGTGGGA GAGCAACGGCCAGCCTGAGAACAACTACAAGACCACCCCC CCTGTGCTGGACAGCGACGGCAGCTTCTTCCTGTACTCCAA ACTGACCGTGGACAAGAGCCGGTGGCAGCAGGGCAACGTG TTCAGCTGCAGCGTGATGCACGAGGCCCTGCACAACCACTA CACCCAGAAGTCCCTGAGCCTGAGCCCCGGCGGAGGCGG CGGAAGCGGAGGAGGAGGATCCAGAGAGGGCCCTGAGCT GAGCCCCGATGATCCTGCTGGACTGCTGGACCTGCGGCAG GGCATGTTTGCTCAGCTGGTGGCCCAGAACGTGCTGCTGAT CGATGGCCCCCTGTCCTGGTACAGCGATCCTGGACTGGCT GGCGTGTCACTGACAGGCGGCCTGAGCTACAAAGAGGACA CCAAAGAACTGGTGGTGGCCAAGGCCGGCGTGTACTACGT GTTCTTTCAGCTGGAACTGCGGAGAGTGGTGGCCGGCGAA GGATCTGGCTCTGTGTCTCTGGCCCTGCATCTGCAGCCTCT GAGAAGCGCTGCTGGCGCTGCAGCTCTGGCACTGACAGTG GATCTGCCTCCTGCCAGCTCCGAGGCCCGGAATAGCGCATT TGGGTTTCAAGGCAGGCTGCTGCACCTGTCTGCCGGCCAG AGGCTGGGAGTGCATCTGCACACAGAGGCCAGGGCTAGAC ACGCCTGGCAGCTGACACAGGGCGCTACAGTGCTGGGCCT GTTCAGAGTGACCCCCGAGATTCCAGCCGGCCTGCCTTCTC CAAGAAGCGAA* |
| 277 | Nucleotide sequence anti-CD19 (8B8-018) light chain | see Table 59 |
| 309 | anti-CD19 (8B8-2B11) Fc hole dimeric ligand chain | QVQLVQSGAEVKKPGASVKVSCKASGYTFTDYIMHWVRQ APGQGLEWMGYINPYNDGSKYTEKFQGRVTMTSDTSISTA YMELSRLRSDDTAVYYCARGTYYYGPQLFDYWGQGTTVT VSSASTKGPSVFPLAPSSKSTSGGTAALGCLVKDYFPEPVTVSW NSGALTSGVHTFPAVLQSSGLYSLSSVVTVPSSSLGTQTYICNVN HKPSNTKVDKKVEPKSCDKTHTCPPCPAPEAAGGPSVFLFPP KPKDTLMISRTPEVTCVVVDVSHEDPEVKFNWYVDGVEVHNA KTKPREEQYNSTYRVVSVLTVLHQDWLNGKEYKCKVSNKALG APIEKTISKAKGQPREPQVCTLPPSRDELTKNQVSLSCAVKGFY PSDIAVEWESNGQPENNYKTTPPVLDSDGSFFLVSKLTVDKSR WQQGNVFSCSVMHEALHNHYTQKSLSLSPGGGGSGGGGSR EGPELSPDDPAGLLDLRQGMFAQLVAQNVLLIDGPLSWYSDP GLAGVSLTGGLSYKEDTKELVVAKAGVYYVFFQLELRRVVAGE GSGSVSLALHLQPLRSAAGAAALALTVDLPASSEARNSAFGFQ GRLLHLSAGQRLGVHLHTEARARHAWQLTQGATVLGLFRVTP EIPAGLPSPRSEGGGGSGGGGSREGPELSPDDPAGLLDLRQG MFAQLVAQNVLLIDGPLSWYSDPGLAGVSLTGGLSYKEDTKEL VVAKAGVYYVFFQLELRRVVAGEGSGSVSLALHLQPLRSAAGA AALALTVDLPASSEARNSAFGFQGRLLHLSAGQRLGVHLHTE ARARHAWQLTQGATVLGLFRVTPEIPAGLPSPRSE |
| 310 | anti-CD19 (8B8-2B11) Fc knob monomeric ligand | QVQLVQSGAEVKKPGASVKVSCKASGYTFTDYIMHWVRQ APGQGLEWMGYINPYNDGSKYTEKFQGRVTMTSDTSISTA YMELSRLRSDDTAVYYCARGTYYYGPQLFDYWGQGTTVT VSSASTKGPSVFPLAPSSKSTSGGTAALGCLVKDYFPEPVTVSW NSGALTSGVHTFPAVLQSSGLYSLSSVVTVPSSSLGTQTYICNVN HKPSNTKVDKKVEPKSCDKTHTCPPCPAPEAAGGPSVFLFPP KPKDTLMISRTPEVTCVVVDVSHEDPEVKFNWYVDGVEVHNA KTKPREEQYNSTYRVVSVLTVLHQDWLNGKEYKCKVSNKALG APIEKTISKAKGQPREPQVYTLPPCRDELTKNQVSLWCLVKGF YPSDIAVEWESNGQPENNYKTTPPVLDSDGSFFLYSKLTVDKS RWQQGNVFSCSVMHEALHNHYTQKSLSLSPGGGGSGGGGS REGPELSPDDPAGLLDLRQGMFAQLVAQNVLLIDGPLSWYSD PGLAGVSLTGGLSYKEDTKELVVAKAGVYYVFFQLELRRVVAG EGSGSVSLALHLQPLRSAAGAAALALTVDLPPASSEARNSAFGF QGRLLHLSAGQRLGVHLHTEARARHAWQLTQGATVLGLFRVT PEIPAGLPSPRSE |
| 279 | anti-CD19 (8B8-018) light chain | see Table 59 |

7.2.6 Preparation of Monovalent CD19(8B8-2B11) Targeted 4-1BB Ligand (71-248) Trimer-Containing Fc (kih) Fusion Antigen Binding Molecule with Crossed CH1-CL Domains with Charged Residues (Construct 4.4)

The construct 4.4 was prepared as described for construct 3.4 (FIG. 30D), but using the variable region of heavy and light chain DNA sequences encoding a binder specific for CD19, clone 8B8-2B11.

Table 65 shows the cDNA and amino acid sequences of the monovalent CD19(8B8-2B11) targeted split trimeric 4-1BB ligand (71-248) Fc (kih) fusion antigen binding molecule with crossed CH-CL and charged residues (construct 4.4).

TABLE 65 cDNA and amino acid sequences of monovalent CD19(8B8-2B11) targeted split trimeric 4-1BB ligand (71-248) Fc (kih) fusion containing CH—CL cross with charged residues (construct 4.4).

| SEQ ID NO: | Description | Sequence |
|---|---|---|
| 169 | Nucleotide sequence dimeric ligand (71-248) - CL* Fc knob chain | see Table 24 |
| 170 | Nucleotide sequence monomeric hu 4-1BBL (71-248) - CH1* | see Table 24 |
| 305 | Nucleotide sequence anti-CD19(8B8-2B11) Fc hole chain | see Table 62 |
| 277 | Nucleotide sequence anti-CD19(8B8-2B11) light chain | see Table 59 |
| 119 | Dimeric ligand (71-248) - CL* Fc knob chain | see Table 24 |
| 120 | Monomeric ligand (71-248) - CH1* | see Table 24 |
| 306 | anti-CD19(8B8-2B11) Fc hole chain | see Table 62 |
| 279 | anti-CD19(8B8-2B11) light chain | see Table 59 |

*charged residues

7.2.7 Preparation of Monovalent CD19(8B8-2B11) Targeted 4-1BB Ligand (71-248) Trimer-Containing Fc (kih) Fusion Antigen Binding Molecule with Crossed CH1-CL Domains without Charged Residues (Construct 4.5)

The construct 4.5 was prepared as described for construct 3.5 (FIG. 30E), but using the variable region of heavy and light chain DNA sequences encoding a binder specific for CD19, clone 8B8-2B11.

Table 66 shows the cDNA and amino acid sequences of the monovalent CD19(8B8-2B11) targeted split trimeric 4-1BB ligand (71-248) Fc (kih) fusion antigen binding molecule containing crossed CH-CL cross without charged residues (construct 4.5).

TABLE 66 cDNA and amino acid sequences of monovalent CD19(8B8-2B11) targeted split trimeric 4-1BB ligand (71-248) Fc (kih) fusion containing CH—CL cross without charged residues (construct 4.5).

| SEQ ID NO: | Description | Sequence |
|---|---|---|
| 171 | Nucleotide sequence dimeric ligand (71-248) - CL Fc knob chain | see Table 25 |
| 172 | Nucleotide sequence monomeric ligand (71-248) - CH1 | see Table 25 |
| 305 | Nucleotide sequence anti-CD19(8B8-2B11) Fc hole chain | see Table 62 |
| 277 | Nucleotide sequence anti-CD19(8B8-2B11) light chain | see Table 59 |
| 173 | Dimeric ligand (71-248) - CL Fc knob chain | see Table 25 |
| 174 | Monomeric ligand (71-248) - CH1 | see Table 25 |
| 306 | anti-CD19(8B8-2B11) Fc hole chain | see Table 62 |
| 279 | anti-CD19(8B8-2B11) light chain | see Table 59 |

7.2.8 Preparation of Bivalent CD19(8B8-2B11) Targeted 4-1BB Ligand (71-248) Trimer-Containing Fc (kih) Fusion Antigen Binding (Construct 4.6)

The construct 4.6 was prepared as described for construct 3.6 (FIG. 30F), but using the variable region of heavy and light chain DNA sequences encoding a binder specific for CD19, clone 8B8-2B11.

Table 67 shows the cDNA and amino acid sequences of the bivalent CD19(8B8-2B11) targeted split trimeric 4-1BB ligand (71-248) Fc (kih) fusion antigen binding molecule (construct 3.6).

TABLE 67 cDNA and amino acid sequences of bivalent CD19 (8B8-2B11) targeted split trimeric 4-1BB ligand (71-248) Fc (kih) fusion (construct 4.6)

| SEQ ID NO: | Description | Sequence |
|---|---|---|
| 311 | Nucleotide sequence anti-CD19 (8B8-2B11) Fc hole dimeric ligand (71-248) chain | CAGGTGCAATTGGTTCAATCTGGTGCTGAAGTAAAAAA ACCGGGCGCTTCCGTTAAAGTGAGCTGCAAAGCATCTGG TTACACCTTCACTGACTATATCATGCACTGGGTTCGTCA GGCCCCGGGCCAGGGTCTGGAGTGGATGGGCTACATTA ACCCATACAACGACGGTTCCAAATATACCGAGAAATTC CAGGGCCGCGTCACGATGACCAGCGACACTTCTATCTCC ACCGCGTACATGGAACTGTCTAGACTGCGTTCTGACGAC ACCGCTGTTTACTATTGTGCACGCGGTACCTACTACTAC GGTCCACAGCTGTTTGATTACTGGGGCCAAGGTACCACG |

TABLE 67-continued cDNA and amino acid sequences of bivalent CD19 (8B8-2B11) targeted split trimeric 4-1BB ligand (71-248) Fc (kih) fusion (construct 4.6)

| SEQ ID NO: | Description | Sequence |
|---|---|---|
| | | GTGACCGTAAGCTCTGCTAGCACCAAGGGCCCCTCCGTGT
TCCCCCTGGCCCCCAGCAGCAAGAGCACCAGCGGCGGCAC
AGCCGCTCTGGGCTGCCTGGTCAAGGACTACTTCCCCGAG
CCCGTGACCGTGTCCTGGAACAGCGGAGCCCTGACCTCCG
GCGTGCACACCTTCCCCGCCGTGCTGCAGAGTTCTGGCCT
GTATAGCCTGAGCAGCGTGGTCACCGTGCCTTCTAGCAGCC
TGGGCACCCAGACCTACATCTGCAACGTGAACCACAAGCCC
AGCAACACCAAGGTGGACAAGAAGGTGGAGCCCAAGAGCT
GCGACAAAACTCACACATGCCCACCGTGCCCAGCACCTGAA
GCTGCAGGGGGACCGTCAGTCTTCCTCTTCCCCCCAAAACC
CAAGGACACCCTCATGATCTCCCGGACCCCTGAGGTCACAT
GCGTGGTGGTGGACGTGAGCCACGAAGACCCTGAGGTCAA
GTTCAACTGGTACGTGGACGGCGTGGAGGTGCATAATGCCA
AGACAAAGCCGCGGGAGGAGCAGTACAACAGCACGTACCG
TGTGGTCAGCGTCCTCACCGTCCTGCACCAGGACTGGCTGA
ATGGCAAGGAGTACAAGTGCAAGGTCTCCAACAAAGCCCTC
GGCGCCCCCATCGAGAAAACCATCTCCAAAGCCAAAGGGC
AGCCCCGAGAACCACAGGTGTGCACCCTGCCCCCATCCCG
GGATGAGCTGACCAAGAACCAGGTCAGCCTCTCGTGCGCA
GTCAAAGGCTTCTATCCCAGCGACATCGCCGTGGAGTGGGA
GAGCAATGGGCAGCCGGAGAACAACTACAAGACCACGCCT
CCCGTGCTGGACTCCGACGGCTCCTTCTTCCTCGTGAGCAA
GCTCACCGTGGACAAGAGCAGGTGGCAGCAGGGGAACGTC
TTCTCATGCTCCGTGATGCATGAGGCTCTGCACAACCACTA
CACGCAGAAGAGCCTCTCCCTGTCTCCGGGTGGAGGCGGC
GGAAGCGGAGGAGGAGGATCCAGAGAGGGCCCTGAGCTG
AGCCCTGATGATCCTGCCGGACTGCTGGACCTGCGGCAGG
GAATGTTTGCCCAGCTGGTGGCCCAGAACGTGCTGCTGATC
GATGGCCCCCTGTCCTGGTACAGCGATCCTGGACTGGCTG
GCGTGTCACTGACAGGCGGCCTGAGCTACAAAGAGGACAC
CAAAGAACTGGTGGTGGCCAAGGCCGGCGTGTACTACGTG
TTCTTTCAGCTGGAACTGCGGAGAGTGGTGGCCGGCGAAG
GATCTGGCTCTGTGTCTCTGGCCCTGCATCTGCAGCCTCTG
AGATCTGCTGCTGGCGCCGCTGCTCTGGCACTGACAGTGG
ATCTGCCTCCTGCCAGCAGCGAGGCCCGGAATAGCGCATTT
GGGTTTCAAGGCAGGCTGCTGCACCTGTCTGCCGGCCAGA
GGCTGGGAGTGCATCTGCACACAGAGGCCAGGGCTAGACA
CGCCTGGCAGCTGACACAGGGCGCTACAGTGCTGGGCCTG
TTCAGAGTGACCCCCGAGATTCCAGCAGGCCTGGGAGGCG
GCGGATCTGGCGGCGGAGGATCTAGAGAAGGACCCGAGCT
GTCCCCCGACGATCCCGCTGGGCTGCTGGATCTGAGACAG
GGCATGTTCGCTCAGCTGGTGGCTCAGAATGTGCTGCTGAT
TGACGGACCTCTGAGCTGGTACTCCGACCCAGGGCTGGCA
GGGGTGTCCCTGACTGGGGACTGTCCTACAAAGAAGATAC
AAAAGAACTGGTGGTGGCTAAAGCTGGGGTGTACTATGTGT
TTTTTCAGCTGGAACTGAGGCGGGTGGTGGCTGGGGAGGG
CTCAGGATCTGTGTCCCTGGCTCTGCATCTGCAGCCACTGC
GCTCTGCAGCAGGGCTGCAGCACTGGCCCTGACTGTGGA
CCTGCCCCAGCTTCTTCCGAGGCCAGAAACAGCGCCTTCG
GGTTCCAAGGACGCCTGCTGCATCTGAGCGCCGGACAGCG
CCTGGGAGTGCATCTGCATACTGAAGCCAGAGCCCGGCAT
GCTTGGCAGCTGACTCAGGGGCAACTGTGCTGGGACTGT
TTCGCGTGACACCTGAGATCCAGCCGGGCTC |
| 312 | Nucleotide sequence anti-CD19 (8B8-2B11) Fc knob monomeric (71-248) ligand | CAGGTGCAATTGGTTCAATCTGGTGCTGAAGTAAAAAA
ACCGGGCGCTTCCGTTAAAGTGAGCTGCAAAGCATCTGG
TTACACCTTCACTGACTATATCATGCACTGGGTTCGTCA
GGCCCCGGGCCAGGGTCTGGAGTGGATGGGCTACATTA
ACCCATACAACGACGGTTCCAAATATACCGAGAAATTC
CAGGGCCGCGTCACGATGACCAGCGACACTTCTATCTCC
ACCGCGTACATGGAACTGTCTAGACTGCGTTCTGACGAC
ACCGCTGTTTACTATTGTGCACGCGGTACCTACTACTAC
GGTCCACAGCTGTTTGATTACTGGGGCCAAGGTACCACG
GTGACCGTAAGCTCTGCTAGCACCAAGGGCCCATCGGTCT
TCCCCCTGGCACCCTCCTCCAAGAGCACCTCTGGGGGCAC
AGCGGCCCTGGGCTGCCTGGTCAAGGACTACTTCCCCGAA
CCGGTGACGGTGTCGTGGAACTCAGGCGCCCTGACCAGCG
GCGTGCACACCTTCCCGGCTGTCCTACAGTCCTCAGGACTC
TACTCCCTCAGCAGCGTGGTGACCGTGCCCTCCAGCAGCTT
GGGCACCCAGACCTACATCTGCAACGTGAATCACAAGCCCA
GCAACACCAAGGTGGACAAGAAAGTTGAGCCCAAATCTTGT
GACAAAACTCACACATGCCCACCGTGCCCAGCACCTGAAGC
TGCAGGGGGACCGTCAGTCTTCCTCTTCCCCCCAAAACCCA
AGGACACCCTCATGATCTCCCGGACCCCTGAGGTCACATGC
GTGGTGGTGGACGTGAGCCACGAAGACCCTGAGGTCAAGT |

TABLE 67-continued cDNA and amino acid sequences of bivalent CD19 (8B8-2B11) targeted
split trimeric 4-1BB ligand (71-248) Fc (kih) fusion (construct 4.6)

| SEQ ID NO: | Description | Sequence |
|---|---|---|
| | | TCAACTGGTACGTGGACGGCGTGGAGGTGCATAATGCCAA GACAAAGCCGCGGGAGGAGCAGTACAACAGCACGTACCGT GTGGTCAGCGTCCTCACCGTCCTGCACCAGGACTGGCTGA ATGGCAAGGAGTACAAGTGCAAGGTCTCCAACAAAGCCCTC GGCGCCCCCATCGAGAAAACCATCTCCAAAGCCAAAGGGC AGCCCCGAGAACCACAGGTGTACACCCTGCCCCCTGCAG AGATGAGCTGACCAAGAACCAGGTGTCCCTGTGGTGTCTGG TCAAGGGCTTCTACCCCAGCGATATCGCCGTGGAGTGGGA GAGCAACGGCCAGCCTGAGAACAACTACAAGACCACCCCC CCTGTGCTGGACAGCGACGGCAGCTTCTTCCTGTACTCCAA ACTGACCGTGGACAAGAGCCGGTGGCAGCAGGGCAACGTG TTCAGCTGCAGCGTGATGCACGAGGCCCTGCACAACCACTA CACCCAGAAGTCCCTGAGCCTGAGCCCCGGCGGAGGCGG CGGAAGCGGAGGAGGAGGATCCAGAGAGGGCCCTGAGCT GAGCCCTGATGATCCTGCCGGACTGCTGGACCTGCGGCAG GGAATGTTTGCCCAGCTGGTGGCCCAGAACGTGCTGCTGAT CGATGGCCCCCTGTCCTGGTACAGCGATCCTGGACTGGCT GGCGTGTCACTGACAGGCGGCCTGAGCTACAAAGAGGACA CCAAAGAACTGGTGGTGGCCAAGGCCGGCGTGTACTACGT GTTCTTTCAGCTGGAACTGCGGAGAGTGGTGGCCGGCGAA GGATCTGGCTCTGTGTCTCTGGCCCTGCATCTGCAGCCTCT GAGATCTGCTGCTGGCGCCGCTGCTCTGGCACTGACAGTG GATCTGCCTCCTGCCAGCAGCGAGGCCCGGAATAGCGCAT TTGGGTTTCAAGGCAGGCTGCTGCACCTGTCTGCCGGCCA GAGGCTGGGAGTGCATCTGCACACAGAGGCCAGGGCTAGA CACGCCTGGCAGCTGACAGGGCGCTACAGTGCTGGGCC TGTTCAGAGTGACCCCGAGATTCCTGCCGGGCTC |
| 277 | Nucleotide sequence anti-CD19 (8B8-2B11) light chain | see Table 59 |
| 313 | anti-CD19 (8B8-2B11) Fc hole dimeric ligand (71-248) chain | QVQLVQSGAEVKKPGASVKVSCKASGYTFTDYIMHWVRQ APGQGLEWMGYINPYNDGSKYTEKFQGRVTMTSDTSISTA YMELSRLRSDDTAVYYCARGTYYYGPQLFDYWGQGTTVT VSSASTKGPSVFPLAPSSKSTSGGTAALGCLVKDYFPEPVTVSW NSGALTSGVHTFPAVLQSSGLYSLSSVVTVPSSSLGTQTYICNVN HKPSNTKVDKKVEPKSCDKTHTCPPCPAPEAAGGPSVFLFPP KPKDTLMISRTPEVTCVVVDVSHEDPEVKFNWYVDGVEVHNA KTKPREEQYNSTYRVVSVLTVLHQDWLNGKEYKCKVSNKALG APIEKTISKAKGQPREPQVCTLPPSRDELTKNQVSLSCAVKGFY PSDIAVEWESNGQPENNYKTTPPVLDSDGSFFLVSKLTVDKSR WQQGNVFSCSVMHEALHNHYTQKSLSLSPGGGGSGGGGSR EGPELSPDDPAGLLDLRQGMFAQLVAQNVLLIDGPLSWYSDP GLAGVSLTGGLSYKEDTKELVVAKAGVYYVFFQLELRRVVAGE GSGSVSLALHLQPLRSAAGAAALALTVDLPPASSEARNSAFGFQ GRLLHLSAGQRLGVHLHTEARARHAWQLTQGATVLGLFRVTP EIPAGLGGGGSGGGGSREGPELSPDDPAGLLDLRQGMFAQL VAQNVLLIDGPLSWYSDPGLAGVSLTGGLSYKEDTKELVVAKA GVYYVFFQLELRRVVAGEGSGSVSLALHLQPLRSAAGAAALALT VDLPPASSEARNSAFGFQGRLLHLSAGQRLGVHLHTEARARHA WQLTQGATVLGLFRVTPEIPAGL |
| 314 | anti-CD19 (8B8-2B11) Fc knob monomeric (71-248) ligand | QVQLVQSGAEVKKPGASVKVSCKASGYTFTDYIMHWVRQ APGQGLEWMGYINPYNDGSKYTEKFQGRVTMTSDTSISTA YMELSRLRSDDTAVYYCARGTYYYGPQLFDYWGQGTTVT VSSASTKGPSVFPLAPSSKSTSGGTAALGCLVKDYFPEPVTVSW NSGALTSGVHTFPAVLQSSGLYSLSSVVTVPSSSLGTQTYICNVN HKPSNTKVDKKVEPKSCDKTHTCPPCPAPEAAGGPSVFLFPP KPKDTLMISRTPEVTCVVVDVSHEDPEVKFNWYVDGVEVHNA KTKPREEQYNSTYRVVSVLTVLHQDWLNGKEYKCKVSNKALG APIEKTISKAKGQPREPQVYTLPPCRDELTKNQVSLWCLVKGF YPSDIAVEWESNGQPENNYKTTPPVLDSDGSFFLYSKLTVDKS RWQQGNVFSCSVMHEALHNHYTQKSLSLSPGGGGSGGGGS REGPELSPDDPAGLLDLRQGMFAQLVAQNVLLIDGPLSWYSD PGLAGVSLTGGLSYKEDTKELVVAKAGVYYVFFQLELRRVVAG EGSGSVSLALHLQPLRSAAGAAALALTVDLPPASSEARNSAFGF QGRLLHLSAGQRLGVHLHTEARARHAWQLTQGATVLGLFRVT PEIPAGL |
| 279 | anti-CD19 (8B8-018) light chain | see Table 59 |

7.3 Preparation of Untargeted Split Trimeric 4-1BB Ligand Fc Fusion and Human IgG as Control Molecules 7.3.1 Preparation of Untargeted Human 4-1BB Ligand Trimer-Containing Fc Fusion Antigen Binding Molecules (Control Molecules)

These control molecules were prepared as described above for the CD19 targeted construct 3.1 (termed control B), 3.3 (termed control C), 3.4 (termed control D) and 3.5 (termed control E) with the only difference that the anti-CD19 binder (VH-VL) was replaced by a germline control, termed DP47, not binding to the antigen (see FIGS. 30A-F).

Table 68 shows, respectively, the cDNA and amino acid sequences of the monovalent DP47-untargeted split trimeric 4-1BB ligand (71-254) Fc (kih) fusion containing crossed CH-CL with charged residues, control B.

Table 69 shows, respectively, the cDNA and amino acid sequences of the bivalent DP47-untargeted split trimeric 4-1BB ligand (71-254) Fc (kih) fusion, control C.

Table 70 shows, respectively, the cDNA and amino acid sequences of the monovalent DP47-untargeted split trimeric 4-1BB ligand (71-248) Fc (kih) fusion containing CH-CL cross with charged residues, control D.

Table 71 shows, respectively, the cDNA and amino acid sequences of the monovalent DP47-untargeted split trimeric 4-1BB ligand (71-248) Fc (kih) fusion without charged residues in the CH-CL cross, control E.

TABLE 68 cDNA and amino acid sequences of monovalent DP47 untargeted split trimeric human 4-1BB ligand (71-254) Fc (kih) fusion with CH—CL cross and with charged residues (control B).

| SEQ ID NO: | Description | Sequence |
|---|---|---|
| 96 | nucleotide sequence dimeric hu 4-1BBL (71-254) - CL* Fc knob chain | see Table 3 |
| 97 | nucleotide sequence monomeric hu 4-1BBL (71-254) - CH1* | see Table 3 |
| 79 | nucleotide sequence DP47 Fc hole chain | see Table 18 |
| 80 | nucleotide sequence DP47 light chain | see Table 18 |
| 98 | Dimeric hu 4-1BBL (71-254) - CL* Fc knob chain | see Table 3 |
| 99 | Monomeric hu 4-1BBL (71-254) - CH1* | see Table 3 |
| 81 | DP47 Fc hole chain | see Table 18 |
| 82 | DP47 light chain | see Table 18 |

*charges residues

TABLE 69 cDNA and amino acid sequences of bivalent DP47 untargeted split trimeric human 4-1BB ligand (71-254) Fc (kih) fusion (control C).

| SEQ ID NO: | Description | Sequence |
|---|---|---|
| 177 | nucleotide sequence DP47 Fc hole chain fused to dimeric hu 4-1BBL (71-254) | see Table 27 |
| 178 | nucleotide sequence DP47 Fc knob chain fused to monomeric hu 4-1BBL (71-254) | see Table 27 |
| 80 | nucleotide sequence DP47 light chain | see Table 18 |
| 179 | DP47 Fc hole chain fused to dimeric hu 4-1BBL (71-254) | see Table 27 |

TABLE 69-continued cDNA and amino acid sequences of bivalent DP47 untargeted split trimeric human 4-1BB ligand (71-254) Fc (kih) fusion (control C).

| SEQ ID NO: | Description | Sequence |
|---|---|---|
| 180 | DP47 Fc knob chain fused to monomeric hu 4-1BBL (71-254) | see Table 27 |
| 82 | DP47 light chain | see Table 18 |

TABLE 70 cDNA and amino acid sequences of monovalent DP47 untargeted split trimeric human 4-1BB ligand (71-248) Fc (kih) fusion with CH—CL cross and with charged residues (control D).

| SEQ ID NO: | Description | Sequence |
|---|---|---|
| 169 | nucleotide sequence dimeric hu 4-1BBL (71-248) - CL* Fc knob chain | see Table 24 |
| 170 | nucleotide sequence monomeric hu 4-1BBL (71-248) - CH1* | see Table 24 |
| 79 | nucleotide sequence DP47 Fc hole chain | see Table 18 |
| 80 | nucleotide sequence DP47 light chain | see Table 18 |
| 119 | Dimeric hu 4-1BBL (71-254) - CL* Fc knob chain | see Table 24 |
| 120 | Monomeric hu 4-1BBL (71-254) - CH1* | see Table 24 |
| 81 | DP47 Fc hole chain | see Table 18 |
| 82 | DP47 light chain | see Table 18 |

*charged residues

TABLE 71 cDNA and amino acid sequences of monovalent DP47 untargeted split trimeric human 4-1BB ligand (71-248) Fc (kih) fusion with CH—CL cross and without charged residues (control E).

| SEQ ID NO: | Description | Sequence |
|---|---|---|
| 171 | nucleotide sequence dimeric hu 4-1BBL (71-248) - CL Fc knob chain | see Table 25 |
| 172 | nucleotide sequence monomeric hu 4-1BBL (71-248) - CH1 | see Table 25 |
| 79 | nucleotide sequence DP47 Fc hole chain | see Table 18 |
| 80 | nucleotide sequence DP47 light chain | see Table 18 |
| 173 | Dimeric hu 4-1BBL (71-248) - CL Fc knob chain | see Table 25 |
| 174 | Monomeric hu 4-1BBL (71-248) - CH1 | see Table 25 |
| 81 | DP47 Fc hole chain | see Table 18 |
| 82 | DP47 light chain | see Table 18 |

7.3.2 Antibodies as Control Molecules

Two control human IgG1 containing PGLALA were prepared.

Table 72 shows the cDNA and amino acid sequences of the anti-CD19 huIgG1 PGLALA (clone 8B8-018), i.e. control G.

Table 73 shows the cDNA and amino acid sequences of germline control DP47 huIgG1 PGLALA (control F).

TABLE 72 cDNA and amino acid sequences of anti-CD19 (8B8-018) huIgG1 PGLALA (control G)

| SEQ ID NO: | Description | Sequence |
|---|---|---|
| 315 | nucleotide sequence CD19 (8B8-018) heavy chain (huIgG1 PGLALA) | CAGGTCCAGCTGGTGCAGTCCGGCGCCGAGGT CAAGAAACCCGGGGCTTCTGTGAAGGTTTCAT GCAAGGCAAGCGGATACACCTTCACCGACTAT ATCATGCATTGGGTCAGGCAGGCCCCTGGCCA AGGTCTCGAATGGATGGGCTACATTAACCCAT ATAATGATGGCTCCAAATACACCGAGAAGTTT CAGGGAAGAGTCACTATGACATCTGACACCAG TATCAGCACTGCTTACATGGAGCTGTCCCGCC TTCGGTCTGATGACACCGCAGTGTATTACTGT GCCAGGGGCACATATTACTACGGCTCAGCTCT GTTCGACTATGGGGGCAGGGAACCACAGTAA CCGTGAGCTCCGCAAGTACTAAGGGCCCATCG GTCTTCCCCCTGGCACCCTCCTCCAAGAGCAC CTCTGGGGGCACAGCGGCCCTGGGCTGCCTGG TCAAGGACTACTTCCCCGAACCGGTGACGGTG TCGTGGAACTCAGGCGCCCTGACCAGCGGCGT GCACACCTTCCCGGCTGTCCTACAGTCCTCAG GACTCTACTCCCTCAGCAGCGTGGTGACCGTG CCCTCCAGCAGCTTGGGCACCCAGACCTACAT CTGCAACGTGAATCACAAGCCCAGCAACACCA AGGTGGACAAGAAAGTTGAGCCCAAATCTTGT GACAAAACTCACACATGCCCACCGTGCCCAGC ACCTGAAGCAGCTGGGGACCGTCAGTCTTCC TCTTCCCCCCAAAACCCAAGGACACCCTCATG ATCTCCCGGACCCCTGAGGTCACATGCGTGGT GGTGGACGTGAGCCACGAAGACCCTGAGGTC AAGTTCAACTGGTACGTGGACGGCGTGGAGGT GCATAATGCCAAGACAAAGCCGCGGGAGGAG CAGTACAACAGCACGTACCGTGTGGTCAGCGT CCTCACCGTCCTGCACCAGGACTGGCTGAATG GCAAGGAGTACAAGTGCAAGGTCTCCAACAA AGCCCTCGGAGCCCCCATCGAGAAAACCATCT CCAAAGCCAAAGGGCAGCCCCGAGAACCACA GGTGTACACCCTGCCCCCATCCCGGGATGAGC TGACCAAGAACCAGGTCAGCCTGACCTGCCTG GTCAAAGGCTTCTATCCCAGCGACATCGCCGT GGAGTGGGAGAGCAATGGGCAGCCGGAGAAC AACTACAAGACCACGCCTCCCGTGCTGGACTC CGACGGCTCCTTCTTCCTCTACAGCAAGCTCAC CGTGGACAAGAGCAGGTGGCAGCAGGGGAAC GTCTTCTCATGCTCCGTGATGCATGAGGCTCTG CACAACCACTACACGCAGAAGAGCCTCTCCCT GTCCCCGGGCAAA |
| 204 | nucleotide sequence CD19 (8B8-018) light chain | see Table 47 |
| 316 | CD19 (8B8-018) heavy chain (huIgG1 PGLALA) | QVQLVQSGAEVKKPGASVKVSCKASGYTFTDYI MHWVRQAPGQGLEWMGYINPYNDGSKYTEKF QGRVTMTSDTSISTAYMELSRLRSDDTAVYYCA RGTYYYGSALFDYWGQGTTVTVSSASTKGPSVF PLAPSSKSTSGGTAALGCLVKDYFPEPVTVSWNS GALTSGVHTFPAVLQSSGLYSLSSVVTVPSSSLG TQTYICNVNHKPSNTKVDKKVEPKSCDKTHTCP PCPAPEAAGGPSVFLFPPKPKDTLMISRTPEVTCV VVDVSHEDPEVKFNWYVDGVEVHNAKTKPREE QYNSTYRVVSVLTVLHQDWLNGKEYKCKVSNK ALGAPIEKTISKAKGQPREPQVYTLPPSRDELTK NQVSLTCLVKGFYPSDIAVEWESNGQPENNYKT TPPVLDSDGSFFLYSKLTVDKSRWQQGNVFSCS VMHEALHNHYTQKSLSLSPGK |
| 206 | CD19(8B8-018) light chain | see Table 47 |

TABLE 73 cDNA and amino acid sequences of germline control DP47 huIgG1 PGLALA (control F)

| SEQ ID NO: | Description | Sequence |
|---|---|---|
| 181 | nucleotide sequence DP47 heavy chain (hu IgG1 PGLALA) | see Table 29 |
| 80 | DP47 light chain | see Table 18 |
| 182 | DP47 heavy chain (hu IgG1 PGLALA) | see Table 29 |
| 82 | DP47 light chain | see Table 18 |

7.4 Production of CD19-Targeted Split Trimeric 4-1BB Ligand Fc Fusion Antigen Binding Molecules and their Control Molecules The targeted and untargeted split trimeric 4-1BB ligand Fc (kih) fusion antigen binding molecule encoding sequences were cloned into a plasmid vector, which drives expression of the insert from an MPSV promoter and contains a synthetic polyA sequence located at the 3' end of the CDS. In addition, the vector contains an EBV OriP sequence for episomal maintenance of the plasmid.

The split trimeric 4-1BB ligand Fc (kih) fusion antigen binding molecule was produced by co-transfecting HEK293-EBNA cells with the mammalian expression vectors using polyethylenimine. The cells were transfected with the corresponding expression vectors. For variants 1, 2, 4, 5 and it's control B, D and E, at a 1:1:1:1 ratio ("vector dimeric ligand-CL-knob chain":"vector monomeric ligand fusion-CH1":"vector anti-CD19 Fab-hole chain":"vector anti-CD19 light chain"). For variant 3, 6 and it's control C, at a 1:1:1 ratio ("vector huIgG1 Fc hole dimeric ligand chain":"vector huIgG1 Fc knob monomeric ligand chain": "vector anti-CD19 light chain"). Human IgGs, used as control in the assay, were produced as for the bispecific construct (for transfection only a vector for light and a vector for heavy chain were used at a 1:1 ratio).

For production in 500 mL shake flasks, 300 million HEK293 EBNA cells were seeded 24 hours before transfection. For transfection cells were centrifuged for 10 minutes at 210×g, and the supernatant was replaced by 20 mL pre-warmed CD CHO medium. Expression vectors (200 µg of total DNA) were mixed in 20 mL CD CHO medium. After addition of 540 µL PEI, the solution was vortexed for 15 seconds and incubated for 10 minutes at room temperature. Afterwards, cells were mixed with the DNA/PEI solution, transferred to a 500 mL shake flask and incubated for 3 hours at 37° C. in an incubator with a 5% $CO_2$ atmosphere. After the incubation, 160 mL of Excell medium supplemented with 6 mM L-Glutamine, 5 g/L PEPSOY and 1.2 mM valproic acid was added and cells were cultured for 24 hours. One day after transfection 12% Feed (amino acid and glucose) were added. After culturing for 7 days, the supernatant was collected by centrifugation for 30-40 minutes at least 400×g. The solution was sterile filtered (0.22 µm filter), supplemented with sodium azide to a final concentration of 0.01% (w/v), and kept at 4° C.

The split trimeric 4-1BB ligand Fc (kih) fusion antigen binding molecule, as well as the IgG, was purified from cell culture supernatants by affinity chromatography using Protein A, followed by size exclusion chromatography. For affinity chromatography, the supernatant was loaded on a MABSELECT SURE® column (CV=5-15 mL, resin from GE Healthcare) equilibrated with sodium phosphate (20 mM), sodium sitrate (20 mM) buffer (pH 7.5). Unbound protein was removed by washing with at least 6 column volumes of the same buffer. The bound protein was eluted using either a linear gradient (20 CV) or a step elution (8 CV) with 20 mM sodium citrate, 100 mM sodium chloride, 100 mM glycine buffer (pH 3.0). For the linear gradient an additional 4 column volumes step elution was applied.

The pH of collected fractions was adjusted by adding 1/10 (v/v) of 0.5M sodium phosphate, pH8.0. The protein was concentrated prior to loading on a HILOAD® Superdex 200 column (GE Healthcare) equilibrated with 20 mM histidine, 140 mM sodium chloride, 0.01% (v/v) TWEEN® 20 (polysorbate 20) solution of pH 6.0.

The protein concentration was determined by measuring the optical density (OD) at 280 nm, using a molar extinction coefficient calculated on the basis of the amino acid sequence. Purity and molecular weight of the targeted trimeric 4-1BB ligand Fc (kih) fusion was analyzed by SDS-PAGE in the presence and absence of a reducing agent (5 mM 1,4-dithiotreitol) and staining with Coomassie SIMPLYBLUE™ SafeStain (Invitrogen USA). The aggregate content of samples was analyzed using a TSKGEL® G3000 SW XL analytical size-exclusion column (Tosoh) equilibrated in 25 mM $K_2HPO_4$, 125 mM NaCl, 200 mM L-arginine monohydrochloride, 0.02% (w/v) $NaN_3$, pH 6.7 running buffer at 25° C.

Table 74 summarizes the yield and final monomer content of the CD19 targeted split trimeric 4-1BB ligand Fc (kih) fusion antigen molecules.

TABLE 74

Biochemical analysis of CD19 targeted split trimeric 4-1BB ligand Fc (kih) fusion antigen binding molecules

| Construct | Monomer [%] (SEC) | Yield [mg/l] |
|---|---|---|
| monovalent CD19(8B8-018) targeted split trimeric 4-1BB ligand (71-254) Fc fusion anitgcontaining CH—CL cross with charged residues (construct 3.1) | 98 | 8.6 |
| bivalent CD19(8B8-018) targeted split trimeric 4-1BB ligand (71-254) Fc fusion (construct 3.3) | 100 | 11.3 |
| monovalent CD19(8B8-018) targeted split trimeric 4-1BB ligand (71-248) Fc fusion containing CH—CL cross with charged residues (construct 3.4) | 99 | 11.5 |
| monovalent CD19(8B8-018) targeted split trimeric 4-1BB ligand (71-248) Fc fusion containing CH—CL cross without charged residues (construct 3.5) | 97 | 13.3 |
| bivalent CD19(8B8-018) targeted split trimeric 4-1BB ligand (71-248) Fc fusion (construct 3.6) | 96 | 19.9 |
| monovalent CD19(8B8-2B11) targeted split trimeric 4-1BB ligand (71-248) Fc fusion containing CH—CL cross with charged residues (construct 4.4) | 99.2 | 21.2 |

Table 75 summarizes the yield and final monomer content of the DP47 untargeted split trimeric 4-1BB ligand Fc (kih) fusion, both monovalent (control B, D and E) and bivalent (control C).

TABLE 75

Biochemical analysis of DP47 untargeted split trimeric 4-1BB ligand Fc (kih) fusion

| Construct | Monomer [%] (SEC) | Yield [mg/l] |
|---|---|---|
| monovalent DP47-untargeted split trimeric human 4-1BB ligand (71-254) Fc (kih) fusion (control B) | 99 | 15.4 |
| bivalent DP47 untargeted split trimeric human 4-1BB ligand (71-254) Fc (kih) fusion (control C) | 98 | 12.6 |
| monovalent DP47-untargeted split trimeric human 4-1BB ligand (71-254) Fc (kih) fusion (control D) | 99.5 | 25.9 |
| monovalent DP47-untargeted split trimeric human 4-1BB ligand (71-254) Fc (kih) fusion (control E) | 93.3 | 4.1 |

Table 76 summarizes the yield and final monomer content of anti-CD19 (8B8-018) and germline DP47 human IgG1 PGLALA (control F).

TABLE 76

Biochemical analysis of control human IgG1 PGLALA

| Construct | Monomer [%] (SEC) | Yield [mg/l] |
|---|---|---|
| anti-CD19(8B8-018) huIgG1 PGLALA | 100 | 36.6 |
| germline DP47 human IgG1 PGLALA | 100 | 50 |

Example 8

Functional Characterization of the CD19 Targeted 4-1BB Ligand Trimer-Containing Fc Fusion Antigen Binding Molecules

8.1. Surface Plasmon Resonance (Affinity)

Binding of CD19 targeted split trimeric 4-1BB ligand Fc fusion antigen binding molecules (constructs 3.4 and 3.6) to the recombinant 4-1BB Fc(kih) and CD19 was assessed by surface plasmon resonance (SPR). All SPR experiments were performed on a BIACORE® T200 instrument at 25 C with HBS-EP as running buffer (0.01 M HEPES pH 7.4, 0.15 M NaCl, 3 mM EDTA, 0.005% Surfactant P20, Biacore, Freiburg/Germany).

Interaction with Human and Cynomolgus 4-1BB

Anti-human Fab antibody (Biacore, Freiburg/Germany) was directly coupled on a CM5 chip at pH 5.0 using the standard amine coupling kit (Biacore, Freiburg/Germany). The immobilization level was approximately 8000 RU. The CD19 targeted split trimeric 4-1BB ligand Fc fusions were captured for 60 seconds at 2 and 5 nM (control D was also injected). Recombinant human or cynomolgus 4-1BB avi His was passed at a concentration range from 2.7 to 2000 nM (3-fold dilution) with a flow of 30 µL/minutes through the flow cells over 120 seconds. The dissociation was monitored for 180 seconds. Bulk refractive index differences were corrected for by subtracting the response obtained on reference flow cell. Here, the antigens were flown over a surface with immobilized anti-human Fab antibody but on which HBS-EP has been injected rather than the antibodies.

Interaction with Human CD19

Anti-human Fab antibody (Biacore, Freiburg/Germany) was directly coupled on a CM5 chip at pH 5.0 using the standard amine coupling kit (Biacore, Freiburg/Germany). The immobilization level was approximately 8000 RU. The CD19 targeted split trimeric 4-1BB ligand Fc fusions, or the control antibody (anti-CD19(8B8-018) huIgG1 PGLALA) were captured for 60 seconds at 20 nM. Recombinant human CD19-Fc(kih) was passed at a concentration range from 7.8 to 500 nM (2-fold dilution) with a flow of 30 µL/minutes through the flow cells over 120 seconds. The dissociation was monitored for 120/1800 seconds. Bulk refractive index differences were corrected for by subtracting the response obtained on reference flow cell. Here, the antigens were flown over a surface with immobilized anti-human Fab antibody but on which HBS-EP has been injected rather than the antibodies.

Kinetic constants were derived using the Biacore T200 Evaluation Software (vAA, Biacore AB, Uppsala/Sweden), to fit rate equations for 1:1 Langmuir binding by numerical integration.

The bispecific constructs 3.4, 3.6 and control D bind similarly to 4-1BB. Table 77 shows the average with standard deviation (in parenthesis) from the two experiments (using the construct capture solution either at 2 nM or 5 nM). The bispecific constructs 3.4 and 3.6 bind human CD19 with a similar affinity as the IgG. Affinity constants for the interaction were determined by fitting to a 1:1 Langmuir binding. For measurements with hu4-1BB and cy4-1BB, average and standard deviation (in parenthesis) are shown (two experiments with 2 or 5 nM capture solution).

TABLE 77

Binding of CD19 targeted split trimeric 4-1BB ligand Fc fusion to recombinant human (hu) 4-1BB, cynomolgus (cy) 4-1BB and human (hu) CD19.

| | Antigen | ka (1/Ms) | kd (1/s) | KD (M) |
|---|---|---|---|---|
| monovalent CD19(8B8-018) targeted split trimeric 4-1BB ligand (71-248) Fc (kih) fusion containing CH—CL cross with charged residues (construct 3.4) | hu 4-1BB | 7.2E+04 (5.9E+03) | 2.5E−02 (1.0E−05) | 3.4E−07 (2.8E−08) |
| | cy 4-1BB | 1.2E+05 (8.6E+03) | 1.3E−02 (1.8E−04) | 1.1E−07 (9.9E−09) |
| | hu CD19 | 2.77E+04 | 2.67E−04 | 9.64E−09 |
| bivalent CD19(8B8-018) targeted split trimeric 4-1BB ligand (71-248) Fc (kih) fusion (construct 3.6) | hu 4-1BB | 6.9E+04 (1.7E+03) | 2.4E−02 (1.5E−04) | 3.5E−07 (1.1E−08) |
| | cy 4-1BB | 1.1E+05 (7.7E+03) | 1.4E−02 (3.1E−04) | 1.3E−07 (1.3E−08) |
| | hu CD19 | 2.55E+04 | 2.69E−04 | 1.06E−08 |
| monovalent DP47 untargeted split trimeric human 4-1BB ligand (71-248) | hu 4-1BB | 7.3E+04 (3.9E+03) | 2.6E−02 (6.3E−04) | 3.5E−07 (1.0E−08) |
| | cy 4-1BB | 1.2E+05 | 1.4E−02 | 1.2E−07 |

TABLE 77-continued

Binding of CD19 targeted split trimeric 4-1BB ligand Fc fusion to recombinant human (hu) 4-1BB, cynomolgus (cy) 4-1BB and human (hu) CD19.

| | Antigen | ka (1/Ms) | kd (1/s) | KD (M) |
|---|---|---|---|---|
| Fc (kih) fusion with CH—CL cross and with charged residues (control D) | 1BB | (1.9E+03) | (1.0E−04) | (2.9E−09) |
| anti-CD19(8B8-018) huIgG1 PGLALA | hu CD19 | 2.12E+04 | 2.61E−04 | 1.23E−08 |

8.2. Surface Plasmon Resonance (Simultaneous Binding)

The capacity of binding simultaneously human 4-1BB Fc(kih) and human CD19 was assessed by surface plasmon resonance (SPR). All SPR experiments were performed on a BIACORE® T200 instrument at 25° C. with HBS-EP as running buffer (0.01 M HEPES pH 7.4, 0.15 M NaCl, 3 mM EDTA, 0.005% Surfactant P20, Biacore, Freiburg/Germany). Biotinylated human 4-1BB Fc(kih) was directly coupled to a flow cell of a streptavidin (SA) sensor chip. Immobilization levels up to 250 resonance units (RU) were used.

The CD19 targeted trimeric split 4-1BBL constructs (constructs 3.1, 3.3, 3.4, 3.5, 3.6, 4.4) were passed at a concentration range of 200 nM with a flow of 30 µL/minute through the flow cells over 90 seconds and dissociation was set to zero sec. Human CD19 was injected as second analyte with a flow of 30 µL/minute through the flow cells over 90 seconds at a concentration of 500 nM (FIG. 34). The dissociation was monitored for 120 sec. Bulk refractive index differences were corrected for by subtracting the response obtained in a reference flow cell, where no protein was immobilized.

As can be seen in the graphs of FIGS. 35A to 35F, all bispecific constructs could bind simultaneously human 4-1BB and human CD19.

Example 9

Functional Characterization of the CD-19 Targeted 4-1BB Ligand Trimer-Containing Fc Fusion Antigen Binding Molecules 9.1. Binding on Activated Human PMBCs of the CD19-Targeted 4-1BB Ligand Trimer-Containing Fc (kih) Fusion Antigen Binding Molecules To determine binding of 4-1BBL trimer-containing Fc fusion antigen binding molecules to human PBMCs, different titrated concentrations of the CD19-targeted 4-1BBL trimer-containing Fc fusion antigen binding molecules were used in the assay as described in Example 5.2.

FIGS. 36A-1 to 36A-3 and 36B-1 to 36B-3 show the binding of Constructs 3.1, 3.3, 3.4, 3.5 and 3.6 as prepared in Example 7 on activated 4-1BB-expressing CD4+ T cells and CD8+ T cells, respectively. Gates were set on living CD45+ CD3+ CD4+ or CD45+ CD3+ CD8+ T cells and MFI of PE-conjugated AffiniPure anti-human IgG IgG Fcγ-fragment-specific goat F(ab')2 fragment were blotted against the titrated concentration of targeted split trimeric 4-1BB ligand Fc fusion variants. Table 78 shows the $EC_{50}$ values as measured for Constructs 3.1, 3.3. 3.4, 3.5 and 3.6 and control molecules.

TABLE 78

Binding on activated 4-1BB-expressing CD4+ T cells and CD8+ T cells

| Construct | $EC_{50}$ [nM] 4-1BB$^+$CD8$^+$ | $EC_{50}$ [nM] 4-1BB$^+$CD4$^+$ |
|---|---|---|
| Control B | 0.05 | 0.26 |
| Control C | 0.02 | 0.30 |
| Control D | 0.04 | 0.28 |
| Control E | 0.13 | 1.22 |
| 3.1 | 0.03 | 0.28 |
| 3.3 | 0.01 | 0.29 |
| 3.4 | 0.15 | 2.04 |
| 3.5 | 0.04 | 1.03 |
| 3.6 | 0.05 | 0.21 |

9.2 Binding to CD19-Expressing Tumor Cells

For binding assays on CD19-expressing tumor cells, the following human CD19-expressing lymphoma cell lines were used: diffuse large non-Hodgkin B cell lymphoma (B-NHL) cell line SU-DHL-8 (DSMZ ACC573), acute B cell precursor lymphoid leukemia cell line Nalm6 (DSMZ ACC-128), diffuse large cell lymphoblast lymphoma cell line Toledo (ATCC CRL-2631) and diffuse large B cell lymphoma cell line OCI-Ly18 (DSMZ ACC-699). The assays were preformed as described for the FAP-expressing MV-3 and WM-266-4 tumor cell lines in Example 5.3.

Gates were set on living tumor cells and MFI of PE-conjugated AffiniPure anti-human IgG IgG Fcγ-fragment-specific goat F(ab')2 fragment were blotted against the titrated concentration of targeted split trimeric 4-1BB ligand Fc fusion constructs.

Figures 1, 37C:
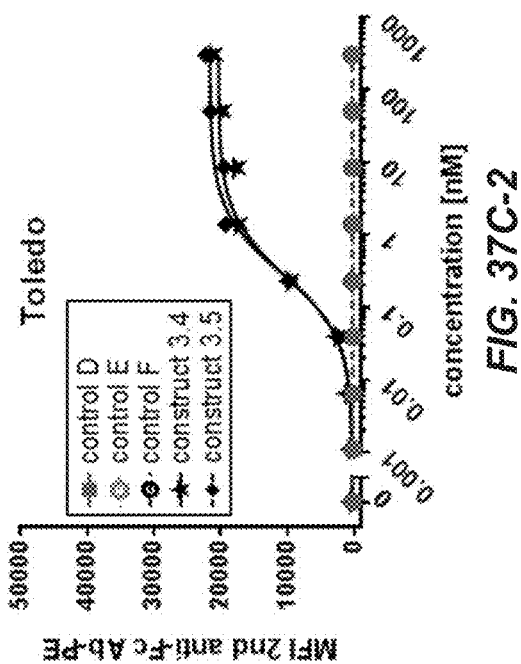
Figures 2, 37C:
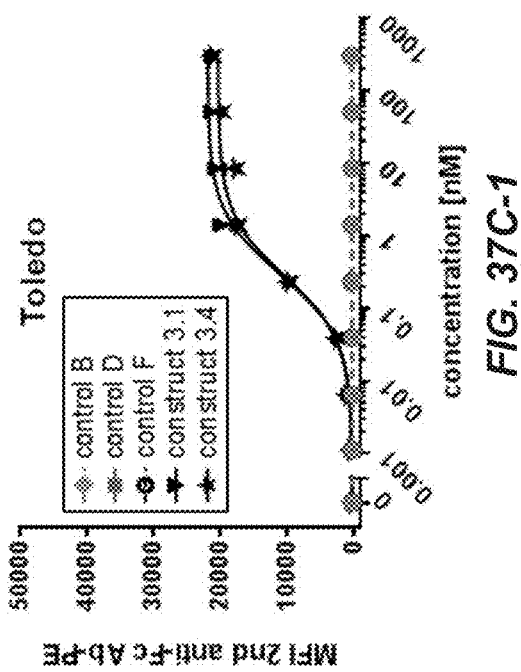
Figures 3, 37C:
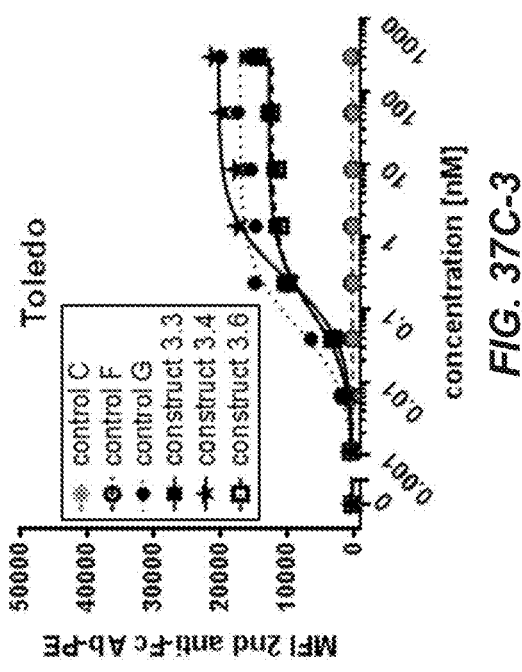
Figures 1, 37D:
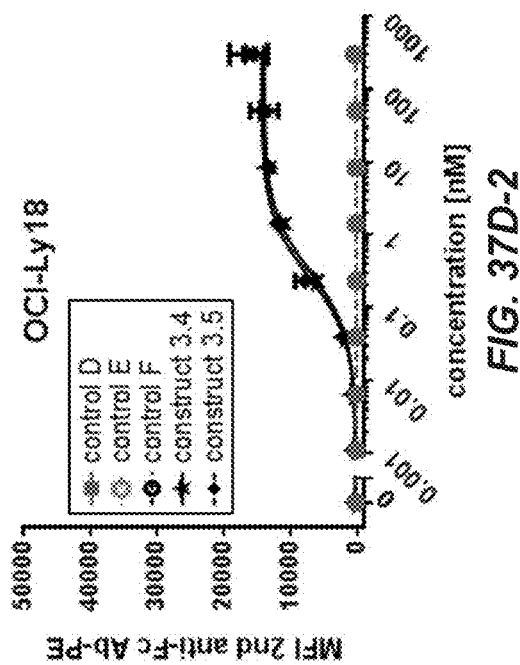
Figures 2, 37D:
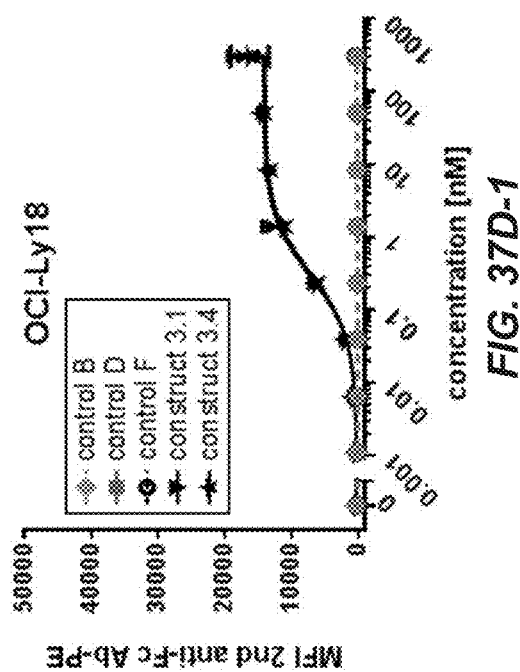
Figures 3, 37D:
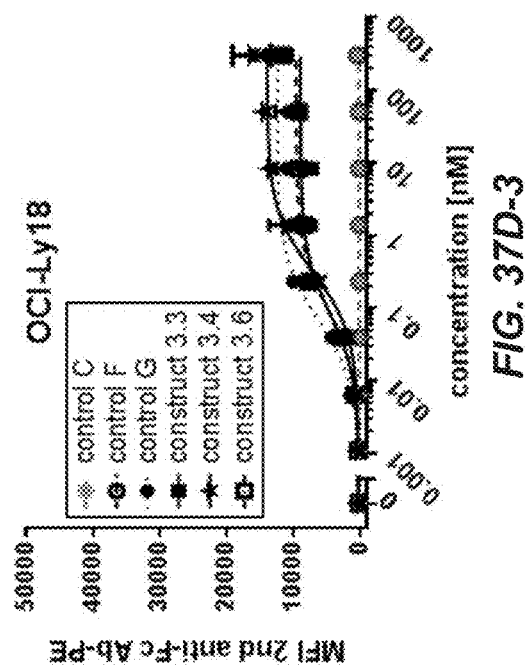

FIG. 37A-1 to 37A-3 shows the binding of Constructs 3.1, 3.3, 3.4, 3.5 and 3.6 as prepared in Example 7.1 to diffuse large non-Hodgkin B cell lymphoma (B-NHL) cell line SU-DHL-8 and in FIG. 37B-1 to 37B-3 the binding of Constructs 3.1, 3.3, 3.4, 3.5 and 3.6 to acute B cell precursor lymphoid leukemia cell line Nalm6 is presented. FIG. 37C-1 to 37C-3 shows the binding of Constructs 3.1, 3.3, 3.4, 3.5 and 3.6 to diffuse large cell lymphoblast lymphoma cell line Toledo and FIG. 37D-1 to 37D-3 shows the binding of Constructs 3.1, 3.3, 3.4, 3.5 and 3.6 to diffuse large B cell lymphoma cell line OCI-Ly18. Table 79 shows the $EC_{50}$ values as measured for Constructs 3.1, 3.3, 3.4, 3.5 and 3.6 and control molecules.

TABLE 79

Binding to CD19-expressing tumor cells

| Construct | $EC_{50}$ [nM] SU-DHL-8 | $EC_{50}$ [nM] Nalm6 | $EC_{50}$ [nM] Toledo | $EC_{50}$ [nM] OCI-Ly18 |
|---|---|---|---|---|
| 3.1 | 0.64 | 0.43 | 0.29 | 0.29 |
| 3.3 | 0.15 | 0.14 | 0.10 | 0.09 |
| 3.4 | 0.31 | 0.39 | 0.29 | 0.26 |

TABLE 79-continued

Binding to CD19-expressing tumor cells

| Construct | EC$_{50}$ [nM] SU-DHL-8 | EC$_{50}$ [nM] Nalm6 | EC$_{50}$ [nM] Toledo | EC$_{50}$ [nM] OCI-Ly18 |
|---|---|---|---|---|
| 3.5 | 0.54 | 0.43 | 0.27 | 0.31 |
| 3.6 | 0.14 | 0.12 | 0.09 | 0.10 |
| control G | 0.09 | 0.10 | 0.06 | 0.07 |

Example 10

Biological Activity of the CD19-Targeted 4-1BB Ligand Trimer-Containing Fc Fusion Antigen Binding Molecules 10.1. NF-κB Activation in HeLa Cells Expressing Human 4-1BB HeLa cells expressing human 4-1BB and NF-κB-luciferase were generated as described in Example 6.1.

NF-κB Activation in Hela Cells Expressing Human 4-1BB Co-Cultured with CD19-Expressing Tumor Cells NF-κB-luciferase human-4-1BB HeLa cells were harvested and resuspended in DMEM medium supplied with 10% (v/v) FBS and 1% (v/v) GlutaMAX-I to a concentration of $0.2 \times 10^6$ cells/ml. 100 µl ($2 \times 10^4$ cells) of this cell suspension were transferred to each well of a sterile white 96-well flat bottom tissue culture plate with lid (greiner bio-one, Cat. No. 655083) and the plate were incubated at 37° C. and 5% CO$_2$ overnight. The next day 50 µL of medium containing titrated concentrations of CD19-targeted 4-1BB ligand trimer-containing Fc fusion antigen binding molecules (CD19 split 4-1BBL trimer) or DP47-untargeted 4-1BB ligand trimer-containing Fc fusion antigen binding molecules (DP47 split 4-1BBL trimer) were added. CD19-expressing B cell lymphoma cell lines (diffuse large non-Hodgkin B cell lymphoma (B-NHL) cell line SU-DHL-8 (DSMZ ACC573) and human non-Hodgkin's B cell lymphoma cell line Pfeiffer (ATCC CRL-2632)) were resuspended in DMEM medium supplied with 10% (v/v) FBS and 1% (v/v) GlutaMAX-I to a concentration of $2 \times 10^6$ cells/ml.

Suspension of CD19-expressing B cell lymphoma cell (50 µl, final ratio 1:5) or only medium were added to each well and plates were incubated for 6 hours at 37° C. and 5% CO$_2$. Cells were washed two times with 200 µL/well DPBS. 40 µl freshly prepared Reporter Lysis Buffer (Promega, Cat-No: E3971) were added to each well and the plate were stored over night at −20° C. The next day frozen cell plate and Detection Buffer (Luciferase 1000 Assay System, Promega, Cat. No. E4550) were thawed at room temperature. 100 µL of detection buffer were added to each well and luciferase activity was measured as fast as possible using a SpectraMax M5/M5e microplate reader and a SoftMax Pro Software (Molecular Devices) counting light emission in URL (units of released light for 0.5s/well) or Victor3 1420 multilabel counter plate reader (Perkin Elmer) and the Perkin Elmer 2030 Manager Software counting light emission as counts per seconds (CPS) and blotted against the concentration of tested constructs.

CD19-targeted 4-1BB ligand trimer-containing Fc fusion antigen binding molecules Constructs 3.1 and 3.3 triggered activation of the NF-kB signaling pathway in the reporter cell line in the presence of CD19-expressing B cell lymphoma cells. In contrast, the untargeted control molecules failed to trigger such an effect at any of the tested concentrations (FIGS. 38A to 38C).

Example 11

11.1 Preparation of CEA (T84.66-LCHA) Targeted 4-1BB Ligand Trimer-Containing Fc Fusion Antigen Binding Molecules 11.1.1 Humanization of Anti-CEA Clone T84.66

Novel humanized variants of the murine antibody T84.66 (Wagener et al., J Immunol 130, 2308 (1983), Neumaier et al., J Immunol 135, 3604 (1985)) were developed by grafting of the CDRs onto human germline framework acceptor sequences.

Humanization of an antibody from non-human origin consists essentially of transplanting the CDR residues from the non-human antibody (donor) onto the framework of a human (acceptor) antibody. Normally the acceptor framework is selected by aligning the sequence of the donor to a collection of potential acceptor sequences and choosing one that has either reasonable homology to the donor, or shows similar amino acids at some positions critical for structure and activity. In the present case, the search for the antibody acceptor framework was performed by aligning the mouse T84.66 protein (NCBI Acc No: CAA36980 for the heavy chain (SEQ ID NO:317), and CAA36979 (SEQ ID NO:318) for the light chain) sequence to a collection of human germ-line sequences and picking that human sequence that showed high sequence identity. Here, the sequence IGHV1-69*08 from the IMGT database was chosen as the heavy chain framework acceptor sequence (IMGT Acc No. Z14309, SEQ ID NO:319), and the IGKV3-11*01 sequence (IMGT Acc No. X01668, SEQ ID NO:320) was chosen to be the framework acceptor for the light chain. Onto these two acceptor frameworks, the three complementary determining regions (CDRs) of the mouse heavy and light variable domains were grafted. Since the framework 4 (FR4) region is not part of the variable region of the germ line V gene, the alignment for that position was done individually. The JH4 sequence was chosen for the heavy chain, and the JK2 sequence was chosen for the light chain.

11.1.2 Binding of Different Humanized Variants of T84.66 IgG to Cells

The binding of different humanized variants of T84.66 IgG was tested on CEA-expressing human gastric adenocarcinoma cells (MKN45, DSMZ ACC 409).

Cells were harvested, counted, checked for viability and re-suspended at $2 \times 10^6$ cells/ml in FACS buffer (100 µl PBS 0.1% BSA). 100 µl of cell suspension (containing $0.2 \times 10^6$ cells) were incubated in round-bottom 96-well plate for 30 min at 4° C. with increasing concentrations of the CEA IgG (4 ng/ml-60 µg/ml), washed twice with cold PBS 0.1% BSA, re-incubated for further 30 min at 4° C. with the PE-conjugated AffiniPure F(ab')2 Fragment goat anti-human IgG Fcg Fragment Specific secondary antibody (Jackson Immuno Research Lab PE #109-116-170), washed twice with cold PBS 0.1% BSA and immediately analyzed by FACS using a FACS CantoII (Software FACS Diva). Binding curves and EC50 values were obtained and calculated using GraphPadPrism5.

FIG. 39 shows the different binding pattern of selected humanized variants of the T84.66 IgG to human CEA, expressed on MKN45 cells. Based on the calculated EC50 binding values (Table 80), the humanized variant 1 was selected for further evaluation.

TABLE 80

Binding of different humanized variants of T84.66 IgGs to cells (EC50 values, based on binding curves shown in FIG. 39, calculated by Graph Pad Prism).

|  | EC50 (μg/ml) |
|---|---|
| Parental chimeric T84.66 | 0.99 |
| Humanized variant 1 | 1.5 |
| Humanized variant 2 | 8.6 |
| Humanized variant 3 | 1.4 |
| Humanized variant 4 | 3.1 |
| Humanized variant 5 | — |
| Humanized variant 6 | — |

Humanized variant 1 is termed in the following T84.66-LCHA. The amino acid sequences of its CDRs and of the VH and VL as well as the aminoacid sequences of the VH and VL domain of the parental chimeric T84.66 clone are shown in Table 81.

TABLE 81

Amino acid sequences of the variable domains of CEA clone T84.66-LCHA and its parental antibody T84.66

| Description | Sequence | SEQ ID NO: |
|---|---|---|
| CEA CDR-H1 | DTYMH | 321 |
| CEA CDR-H2 | RIDPANGNSKYVPKFQG | 322 |
| CEA CDR-H3 | FGYYVSDYAMAY | 323 |
| CEA CDR-L1 | RAGESVDIFGVGFLH | 324 |
| CEA CDR-L2 | RASNRAT | 325 |
| CEA CDR-L3 | QQTNEDPYT | 326 |
| Parental CEA binder VH | EVQLQQSGAELVEPGASVKLSCTASGFNIKDTYMHWVKQRPEQGLEWIGRIDPANGNSKYVPKFQGKATITADTSSNTAYLQLTSLTSEDTAVYYCAPFGYYVSDYAMAYWGQGTSVTVSS | 327 |
| Parental CEA binder VL | DIVLTQSPASLAVSLGQRATMSCRAGESVDIFGVGFLHWYQQKPGQPPKLLIYRASNLESGIPVRFSGTGSRTDFTLIIDPVEADDVATYYCQQTNEDPYTFGGGTKLEIK | 328 |
| Humanized CEA binder CEA (T84.66-LCHA) VH | QVQLVQSGAEVKKPGSSVKVSCKASGFNIKDTYMHWVRQAPGQGLEWMGRIDPANGNSKYVPKFQGRVTITADTSTSTAYMELSSLRSEDTAVYYCAPFGYYVSDYAMAYWGQGTLVTVSS | 329 |
| Humanized CEA binder CEA (T84.66-LCHA) VL | EIVLTQSPATLSLSPGERATLSCRAGESVDIFGVGFLHWYQQKPGQAPRLLIYRASNRATGIPARFSGSGSGTDFTLTISSLEPEDFAVYYCQQTNEDPYTFGQGTKLEIK | 330 |

11.2 Preparation of CEA (T84.66-LCHA) Targeted 4-1BB Ligand Trimer-Containing Fc Fusion Antigen Binding Molecules Different fragments of the DNA sequence encoding part of the ectodomain (amino acid 71-254 and 71-248) of human 4-1BB ligand were synthesized according to the P41273 sequence of Uniprot database (SEQ ID NO:42).

11.2.1 Preparation of Monovalent CEA (T84.66-LCHA) Targeted 4-1BB Ligand (71-254) Trimer-Containing Fc (kih) Fusion Antigen Binding Molecule with Crossed CH1-CL Domains with Charged Residues (Construct 5.1)

A polypeptide containing two ectodomains of 4-1BB ligand (71-254), separated by $(G_4S)_2$ (SEQ ID NO:13) linkers, and fused to the human IgG1-CL domain, was cloned as depicted in FIG. 29A: human 4-1BB ligand, $(G_4S)_2$ (SEQ ID NO:13) connector, human 4-1BB ligand, $(G_4S)_2$ (SEQ ID NO:13) connector, human CL. A polypeptide containing one ectodomain of 4-1BB ligand (71-254) and fused to the human IgG1-CH domain, was cloned as described in FIG. 29B: human 4-1BB ligand, $(G_4S)_2$ (SEQ ID NO:13) connector, human CH.

To improve correct pairing the following mutations have been introduced in the crossed CH-CL. In the dimeric 4-1BB ligand fused to human CL, E123R and Q124K. In the monomeric 4-1BB ligand fused to human CH1, K147E and K213E.

The variable region of heavy and light chain DNA sequences encoding a binder specific for CEA, clone T84.66-LCHA, were subcloned in frame with either the constant heavy chain of the hole or the constant light chain of human IgG1. The Pro329Gly, Leu234Ala and Leu235Ala mutations have been introduced in the constant region of the knob and hole heavy chains to abrogate binding to Fc gamma receptors according to the method described in WO 2012/130831.

Combination of the dimeric ligand-Fc knob chain containing the S354C/T366W mutations, the monomeric CH1 fusion, the targeted anti-CEA-Fc hole chain containing the Y349C/T366S/L368A/Y407V mutations and the anti-CEA light chain allows generation of a heterodimer, which includes an assembled trimeric 4-1BB ligand and a CEA binding Fab (FIG. 40A, Construct 5.1).

Table 82 shows the cDNA and amino acid sequences of the monovalent CEA (T84.66-LCHA) targeted split trimeric 4-1BB ligand (71-254) Fc (kih) fusion antigen binding molecule with crossed CH-CL and charged residues (construct 5.1).

TABLE 82 cDNA and amino acid sequences of monovalent CEA (T84.66-LCHA) targeted split trimeric 4-1BB ligand (71-254) Fc (kih) fusion containing CH—CL cross with charged residues (construct 5.1).

| SEQ ID NO: | Description | Sequence |
|---|---|---|
| 129 | Nucleotide sequence Dimeric hu 4-1BBL (71-254)-CL* Fc knob chain | see Table 3 |
| 130 | Nucleotide sequence Monomeric hu 4-1BBL (71-254)-CH1* | see Table 3 |
| 331 | Nucleotide sequence anti-CEA (T84.66-LCHA) Fc hole chain | CAGGTGCAGCTGGTGCAGTCTGGCGCCGAAGTGAAGAA<br>ACCCGGCAGCAGCGTGAAGGTGTCCTGCAAGGCCAGCG<br>GCTTCAACATCAAGGACACCTACATGCACTGGGTGCGCC<br>AGGCCCCTGGACAGGGACTGGAATGGATGGGCAGAATC<br>GACCCCGCCAACGGCAACAGCAAATACGTGCCCAAGTT<br>CCAGGGCAGAGTGACCATCACCGCCGACACCAGCACCT<br>CCACCGCCTACATGGAACTGAGCAGCCTGCGGAGCGAG<br>GACACCGCCGTGTACTACTGTGCCCCCTTCGGCTACTAC<br>GTGTCCGACTACGCCATGGCCTATTGGGGCCAGGGCAC<br>ACTCGTGACCGTGTCCTCTGCTAGCACCAAGGGCCCCTC<br>CGTGTTCCCCCTGGCCCCCAGCAGCAAGAGCACCAGCG<br>GCGGCACAGCCGCTCTGGGCTGCCTGGTCAAGGACTACT<br>TCCCCGAGCCCGTGACCGTGTCCTGGAACAGCGGAGCC<br>CTGACCTCCGGCGTGCACACCTTCCCCGCCGTGCTGCAG<br>AGTTCTGGCCTGTATAGCCTGAGCAGCGTGGTCACCGTG<br>CCTTCTAGCAGCCTGGGCACCCAGACCTACATCTGCAAC<br>GTGAACCACAAGCCCAGCAACACCAAGGTGGACAAGAA<br>GGTGGAGCCCAAGAGCTGCGACAAAACTCACACATGCC<br>CACCGTGCCCAGCACCTGAAGCTGCAGGGGACCGTCA<br>GTCTTCCTCTTCCCCCCAAAACCCAAGGACACCCTCATG<br>ATCTCCCGGACCCCTGAGGTCACATGCGTGGTGGTGGAC<br>GTGAGCCACGAAGACCCTGAGGTCAAGTTCAACTGGTA<br>CGTGGACGGCGTGGAGGTGCATAATGCCAAGACAAAGC<br>CGCGGGAGGAGCAGTACAACAGCACGTACCGTGTGGTC<br>AGCGTCCTCACCGTCCTGCACCAGGACTGGCTGAATGGC<br>AAGGAGTACAAGTGCAAGGTCTCCAACAAAGCCCTCGG<br>CGCCCCCATCGAGAAAACCATCTCCAAAGCCAAAGGGC<br>AGCCCCGAGAACCACAGGTGTGCACCCTGCCCCCATCCC<br>GGGATGAGCTGACCAAGAACCAGGTCAGCCTCTCGTGC<br>GCAGTCAAAGGCTTCTATCCCAGCGACATCGCCGTGGA<br>GTGGGAGAGCAATGGGCAGCCGGAGAACAACTACAAGA<br>CCACGCCTCCCGTGCTGGACTCCGACGGCTCCTTCTTCC<br>TCGTGAGCAAGCTCACCGTGGACAAGAGCAGGTGGCAG<br>CAGGGGAACGTCTTCTCATGCTCCGTGATGCATGAGGCT<br>CTGCACAACCACTACACGCAGAAGAGCCTCTCCCTGTCT<br>CCGGGTAAA |
| 332 | Nucleotide sequence anti-CEA (T84.66-LCHA) light chain | GAGATCGTGCTGACCCAGAGCCCTGCCACCCTGTCACTG<br>TCTCCAGGCGAGAGAGCCACCCTGAGCTGTAGAGCCGG<br>CGAGAGCGTGGACATCTTCGGCGTGGGATTTCTGCACTG<br>GTATCAGCAGAAGCCCGGCCAGGCCCCCAGACTGCTGA<br>TCTACAGAGCCAGCAACCGGGCCACAGGCATCCCCGCC<br>AGATTTTCTGGCTCTGGCAGCGGCACCGACTTCACCCTG<br>ACAATCAGCAGCCTGGAACCCGAGGACTTCGCCGTGTA<br>CTACTGCCAGCAGACCAACGAGGACCCCTACACCTTTGG<br>CCAGGGCACCAAGCTGGAAATCAAGCGTACGGTGGCTG<br>CACCATCTGTCTTCATCTTCCCGCCATCTGATGAGCAGTT<br>GAAATCTGGAACTGCCTCTGTTGTGTGCCTGCTGAATAA<br>CTTCTATCCCAGAGAGGCCAAAGTACAGTGGAAGGTGG<br>ATAACGCCCTCCAATCGGGTAACTCCCAGGAGAGTGTC<br>ACAGAGCAGGACAGCAAGGACAGCACCTACAGCCTCAG<br>CAGCACCCTGACGCTGAGCAAAGCAGACTACGAGAAAC<br>ACAAAGTCTACGCCTGCGAAGTCACCCATCAGGGCCTG<br>AGCTCGCCCGTCACAAAGAGCTTCAACAGGGGAGAGTGT |
| 115 | Dimeric hu 4-1BBL (71-254)-CL* Fc knob chain | see Table 3 |

TABLE 82-continued cDNA and amino acid sequences of monovalent CEA (T84.66-LCHA) targeted split trimeric 4-1BB ligand (71-254) Fc (kih) fusion containing CH—CL cross with charged residues (construct 5.1).

| SEQ ID NO: | Description | Sequence |
|---|---|---|
| 116 | Monomeric hu 4-1BBL (71-254)-CH1* | see Table 3 |
| 333 | anti-CEA (T84.66-LCHA) Fc hole chain | QVQLVQSGAEVKKPGSSVKVSCKASGFNIKDTYMHWVRQ APGQGLEWMGRIDPANGNSKYVPKFQGRVTITADTSTSTA YMELSSLRSEDTAVYYCAPFGYYVSDYAMAYWGQGTLV TVSSASTKGPSVFPLAPSSKSTSGGTAALGCLVKDYFPEPV TVSWNSGALTSGVHTFPAVLQSSGLYSLSSVVTVPSSSLGT QTYICNVNHKPSNTKVDKKVEPKSCDKTHTCPPCPAPEAA GGPSVFLFPPKPKDTLMISRTPEVTCVVVDVSHEDPEVKFNW YVDGVEVHNAKTKPREEQYNSTYRVVSVLTVLHQDWLN GKEYKCKVSNKALGAPIEKTISKAKGQPREPQVCTLPPSRD ELTKNQVSLSCAVKGFYPSDIAVEWESNGQPENNYKTTPP VLDSDGSFFLVSKLTVDKSRWQQGNVFSCSVMHEALHNH YTQKSLSLSPGK |
| 334 | anti-CEA (T84.66-LCHA) light chain | EIVLTQSPATLSLSPGERATLSCRAGESVDIFGVGFLHWYQ QKPGQAPRLLIYRASNRATGIPARFSGSGSGTDFTLTISSLEP EDFAVYYCQQTNEDPYTFGQGTKLEIKRTVAAPSVFIFPPS DEQLKSGTASVVCLLNNFYPREAKVQWKVDNALQSGNSQ ESVTEQDSKDSTYSLSSTLTLSKADYEKHKVYACEVTHQG LSSPVTKSFNRGEC |

*for charged residues 11.2.2 Preparation of Monovalent CEA (T84.66-LCHA) Targeted 4-1BB Ligand (71-254) Trimer-Containing Fc (kih) Fusion Antigen Binding Molecule with Crossed CH1-CL Domains without Charged Residues (Construct 5.2)

A polypeptide containing two ectodomains of 4-1BB ligand (71-254), separated by (G$_4$S)$_2$ (SEQ ID NO:13) linkers, and fused to the human IgG1-CL domain, was cloned in analogy as depicted in FIG. 29A), but without amino acid mutations in the CL domain: human 4-1BB ligand, (G$_4$S)$_2$ (SEQ ID NO:13) connector, human 4-1BB ligand, (G$_4$S)$_2$ (SEQ ID NO:13) connector, human CL. A polypeptide containing one ectodomain of 4-1BB ligand (71-254) and fused to the human IgG1-CH1 domain, was cloned in analogy as depicted in FIG. 29B), but without amino acid mutations in the CH1 domain: human 4-1BB ligand, (G$_4$S)$_2$ (SEQ ID NO:13) connector, human CH1.

The variable region of heavy and light chain DNA sequences encoding a binder specific for CEA, clone T84.66-LCHA, were subcloned in frame with either the constant heavy chain of the hole or the constant light chain of human IgG1.

The Pro329Gly, Leu234Ala and Leu235Ala mutations have been introduced in the constant region of the knob and hole heavy chains to abrogate binding to Fc gamma receptors according to the method described in WO 2012/130831. Combination of the dimeric ligand-Fc knob chain containing the S354C/T366W mutations, the monomeric CH1 fusion, the targeted anti-CEA-Fc hole chain containing the Y349C/T366S/L368A/Y407V mutations and the anti-CEA light chain allows generation of a heterodimer, which includes an assembled trimeric 4-1BB ligand and a CEA-binding Fab (FIG. 40B, Construct 5.2).

Table 83 shows the cDNA and amino acid sequences of the monovalent CEA (T84.66-LCHA) targeted split trimeric 4-1BB ligand (71-254) Fc (kih) fusion antigen binding molecule containing crossed CH-CL cross without charged residues (construct 5.2).

TABLE 83 cDNA and amino acid sequences of monovalent CEA (T84.66-LCHA) targeted split trimeric 4-1BB ligand (71-254) Fc (kih) fusion containing CH—CL cross without charged residues (construct 5.2)

| SEQ ID NO: | Description | Sequence |
|---|---|---|
| 165 | Nucleotide sequence dimeric ligand (71-254)-CL Fc knob chain | see Table 22 |
| 166 | Nucleotide sequence monomeric hu 4-1BBL (71-254)-CH1 | see Table 22 |
| 331 | Nucleotide sequence anti-CEA (T84.66-LCHA) Fc hole chain | see Table 82 |
| 332 | Nucleotide sequence anti-CEA (T84.66-LCHA) light chain | see Table 82 |
| 117 | Dimeric ligand (71-254)-CL Fc knob chain | see Table 22 |
| 118 | Monomeric ligand (71-254)-CH1 | see Table 22 |
| 333 | anti-CEA (T84.66-LCHA) Fc hole chain | see Table 82 |
| 334 | anti-CEA (T84.66-LCHA) light chain | see Table 82 |

11.2.3 Preparation of Bivalent CEA(T84.66-LCHA) Targeted 4-1BB Ligand (71-254) Trimer-Containing Fc (kih) Fusion Antigen Binding (Construct 5.3)

A polypeptide containing two ectodomains of 4-1BB ligand (71-254), separated by (G$_4$S)$_2$ (SEQ ID NO:13) linkers was fused to the C-terminus of human IgG1 Fc hole chain, as depicted in FIG. 29C: human IgG1 Fc hole, (G$_4$S)$_2$ (SEQ ID NO:13) connector, human 4-1BB ligand, (G$_4$S)$_2$ (SEQ ID NO:13) connector, human 4-1BB ligand. A polypeptide containing one ectodomain of 4-1BB ligand (71-254) and fused to the C-terminus of human IgG1 Fc knob chain as described in FIG. 29D: human IgG1 Fc knob, (G$_4$S)$_2$ (SEQ ID NO:13) connector, human 4-1BB ligand.

The variable region of heavy and light chain DNA sequences encoding a binder specific for CEA, clone T84.66-LCHA, were subcloned in frame with either the constant heavy chain of the hole, the knob or the constant light chain of human IgG1. The Pro329Gly, Leu234Ala and Leu235Ala mutations have been introduced in the constant region of the knob and hole heavy chains to abrogate binding to Fc gamma receptors according to the method described in WO 2012/130831. Combination of the anti-CEA huIgG1 hole dimeric ligand chain containing the Y349C/T366S/L368A/Y407V mutations, the anti-CEA huIgG1 knob monomeric ligand chain containing the S354C/T366W mutations and the anti-CEA light chain allows generation of a heterodimer, which includes an assembled trimeric 4-1BB ligand and two CEA binding Fabs (FIG. 40C, construct 5.3).

Table 84 shows the cDNA and amino acid sequences of the bivalent CEA(T84.66-LCHA) targeted split trimeric 4-1BB ligand (71-254) Fc (kih) fusion antigen binding molecule (construct 5.3).

TABLE 84 cDNA and amino acid sequences of bivalent CEA (T84.66-LCHA) targeted split trimeric 4-1BB ligand (71-254) Fc (kih) PGLALA fusion (construct 5.3)

| SEQ ID NO: | Description | Sequence |
|---|---|---|
| 335 | Nucleotide sequence anti-CEA (T84.66-LCHA) Fc hole dimeric 4-1BBL (71-254) chain | CAGGTGCAGCTGGTGCAGTCTGGCGCCGAAGTGAAGAA ACCCGGCAGCAGCGTGAAGGTGTCCTGCAAGGCCAGCG GCTTCAACATCAAGGACACCTACATGCACTGGGTGCGCC AGGCCCCTGGACAGGGACTGGAATGGATGGGCAGAATC GACCCCGCCAACGGCAACAGCAAATACGTGCCCAAGTT CCAGGGCAGAGTGACCATCACCGCCGACACCAGCACCT CCACCGCCTACATGGAACTGAGCAGCCTGCGGAGCGAG GACACCGCCGTGTACTACTGTGCCCCCTTCGGCTACTAC GTGTCCGACTACGCCATGGCCTATTGGGGCCAGGGCAC ACTCGTGACCGTGTCCTCTGCTAGCACCAAGGGCCCCTCC GTGTTCCCCCTGGCCCCCAGCAGCAAGAGCACCAGCGGCG GCACAGCCGCTCTGGGCTGCCTGGTCAAGGACTACTTCCC CGAGCCCGTGACCGTGTCCTGGAACAGCGGAGCCCTGACC TCCGGCGTGCACACCTTCCCCGCCGTGCTGCAGAGTTCTG GCCTGTATAGCCTGAGCAGCGTGGTCACCGTGCCTTCTAGC AGCCTGGGCACCCAGACCTACATCTGCAACGTGAACCACAA GCCCAGCAACACCAAGGTGGACAAGAAGGTGGAGCCCAAG AGCTGCGACAAAACTCACACATGCCCACCGTGCCCAGCACC TGAAGCTGCAGGGGGACCGTCAGTCTTCCTCTTCCCCCAA AACCCAAGGACACCCTCATGATCTCCCGGACCCCTGAGGTC ACATGCGTGGTGGTGGACGTGAGCCACGAAGACCCTGAGG TCAAGTTCAACTGGTACGTGGACGGCGTGGAGGTGCATAAT GCCAAGACAAAGCCGCGGGAGGAGCAGTACAACAGCACGT ACCGTGTGGTCAGCGTCCTCACCGTCCTGCACCAGGACTG GCTGAATGGCAAGGAGTACAAGTGCAAGGTCTCCAACAAAG CCCTCGGCGCCCCCATCGAGAAAACCATCTCCAAAGCCAAA GGGCAGCCCCGAGAACCACAGGTGTGCACCCTGCCCCCAT CCCGGGATGAGCTGACCAAGAACCAGGTCAGCCTCTCGTG CGCAGTCAAAGGCTTCTATCCCAGCGACATCGCCGTGGAGT GGGAGAGCAATGGGCAGCCGGAGAACAACTACAAGACCAC GCCTCCCGTGCTGGACTCCGACGGCTCCTTCTTCCTCGTGA GCAAGCTCACCGTGGACAAGAGCAGGTGGCAGCAGGGGAA CGTCTTCTCATGCTCCGTGATGCATGAGGCTCTGCACAACC ACTACACGCAGAAGAGCCTCTCCCTGTCTCCGGGTGGAGG CGGCGGAAGCGGAGGAGGAGGATCCAGAGAGGGCCCTGA GCTGAGCCCCGATGATCCTGCTGGACTGCTGGACCTGCGG CAGGGCATGTTTGCTCAGCTGGTGGCCCAGAACGTGCTGCT GATCGATGGCCCCCTGTCCTGGTACAGCGATCCTGGACTG GCTGGCGTGTCACTGACAGGCGGCCTGAGCTACAAAGAGG ACACCAAAGAACTGGTGGTGGCCAAGGCCGGCGTGTACTA CGTGTTCTTTCAGCTGGAACTGCGGAGAGTGGTGGCCGGC GAAGGATCTGGCTCTGTGTCTCTGGCCCTGCATCTGCAGCC TCTGAGAAGCGCTGCTGGCGCTGCAGCTCTGGCACTGACA GTGGATCTGCCTCCTGCCAGCTCCGAGGCCCGGAATAGCG CATTTGGGTTTCAAGGCAGGCTGCTGCACCTGTCTGCCGGC CAGAGGCTGGGAGTGCATCTGCACACAGAGGCCAGGGCTA GACACGCCTGGCAGCTGACACAGGGCGCTACAGTGCTGGG CCTGTTCAGAGTGACCCCCGAGATTCCAGCCGGCCTGCCTT CTCCAAGAAGCGAAGGCGGAGGCGGATCTGGCGGCGGAG GATCTAGAGAGGGACCCGAACTGTCCCCTGACGATCCAGC CGGGCTGCTGGATCTGAGACAGGGAATGTTCGCCCAGCTG GTGGCTCAGAATGTGCTGCTGATTGACGGACCTCTGAGCTG GTACTCCGACCCAGGGCTGGCAGGGGTGTCCCTGACTGGG GGACTGTCCTACAAAGAAGATACAAAAGAACTGGTGGTGGC TAAAGCTGGGGTGTACTATGTGTTTTTTCAGCTGGAACTGAG GCGGGTGGTGGCTGGGGAGGGCTCAGGATCTGTGTCCCTG GCTCTGCATCTGCAGCCACTGCGCTCTGCTGCTGGCGCAG CTGCACTGGCTCTGACTGTGGACCTGCCACCAGCCTCTAGC GAGGCCAGAAACAGCGCCTTCGGGTTCCAAGGACGCCTGC TGCATCTGAGCGCCGGACAGCGCCTGGGAGTGCATCTGCA TACTGAAGCCAGAGCCCGGCATGCTTGGCAGCTGACTCAG GGGCAACTGTGCTGGGACTGTTTCGCGTGACACCTGAGAT CCCTGCCGGACTGCAAGCCCTAGATCAGAA |

TABLE 84-continued cDNA and amino acid sequences of bivalent CEA (T84.66-LCHA)
targeted split trimeric 4-1BB ligand (71-254) Fc (kih) PGLALA
fusion (construct 5.3)

| SEQ ID NO: | Description | Sequence |
|---|---|---|
| 336 | Nucleotide sequence anti-CEA (T84.66-LCHA) Fc knob monomeric 41-BBL (71-254) | CAGGTGCAGCTGGTGCAGTCTGGCGCCGAAGTGAAGAA ACCCGGCAGCAGCGTGAAGGTGTCCTGCAAGGCCAGCG GCTTCAACATCAAGGACACCTACATGCACTGGGTGCGCC AGGCCCCTGGACAGGGACTGGAATGGATGGGCAGAATC GACCCCGCCAACGGCAACAGCAAATACGTGCCCAAGTT CCAGGGCAGAGTGACCATCACCGCCGACACCAGCACCT CCACCGCCTACATGGAACTGAGCAGCCTGCGGAGCGAG GACACCGCCGTGTACTACTGTGCCCCCTTCGGCTACTAC GTGTCCGACTACGCCATGGCCTATTGGGGCCAGGGCAC ACTCGTGACCGTGTCCTCTGCTAGCACCAAGGGCCCATCG GTCTTCCCCCTGGCACCCTCCTCCAAGAGCACCTCTGGGG GCACAGCGGCCCTGGGCTGCCTGGTCAAGGACTACTTCCC CGAACCGGTGACGGTGTCGTGGAACTCAGGCGCCCTGACC AGCGGCGTGCACACCTTCCCGGCTGTCCTACAGTCCTCAG GACTCTACTCCCTCAGCAGCGTGGTGACCGTGCCCTCCAGC AGCTTGGGCACCCAGACCTACATCTGCAACGTGAATCACAA GCCCAGCAACACCAAGGTGGACAAGAAAGTTGAGCCCAAAT CTTGTGACAAAACTCACACATGCCCACCGTGCCCAGCACCT GAAGCTGCAGGGGGACCGTCAGTCTTCCTCTTCCCCCCAAA ACCCAAGGACACCCTCATGATCTCCCGGACCCCTGAGGTCA CATGCGTGGTGGTGGACGTGAGCCACGAAGACCCTGAGGT CAAGTTCAACTGGTACGTGGACGGCGTGGAGGTGCATAATG CCAAGACAAAGCCGCGGGAGGAGCAGTACAACAGCACGTA CCGTGTGGTCAGCGTCCTCACCGTCCTGCACCAGGACTGG CTGAATGGCAAGGAGTACAAGTGCAAGGTCTCCAACAAAGC CCTCGGCGCCCCCATCGAGAAAACCATCTCCAAAGCCAAAG GGCAGCCCCGAGAACCACAGGTGTACACCCTGCCCCCCTG CAGAGATGAGCTGACCAAGAACCAGGTGTCCCTGTGGTGTC TGGTCAAGGGCTTCTACCCCAGCGATATCGCCGTGGAGTG GGAGAGCAACGGCCAGCCTGAGAACAACTACAAGACCACC CCCCCTGTGCTGGACAGCGACGGCAGCTTCTTCCTGTACTC CAAACTGACCGTGGACAAGAGCCGGTGGCAGCAGGGCAAC GTGTTCAGCTGCAGCGTGATGCACGAGGCCCTGCACAACC ACTACACCCAGAAGTCCCTGAGCCTGAGCCCCGGCGGAGG CGGCGGAAGCGGAGGAGGAGGATCCAGAGAGGGCCCTGA GCTGAGCCCCGATGATCCTGCTGGACTGCTGGACCTGCGG CAGGGCATGTTTGCTCAGCTGGTGGCCCAGAACGTGCTGCT GATCGATGGCCCCCTGTCCTGGTACAGCGATCCTGGACTG GCTGGCGTGTCACTGACAGGCGGCCTGAGCTACAAAGAGG ACACCAAAGAACTGGTGGTGGCCAAGGCCGGCGTGTACTA CGTGTTCTTTCAGCTGGAACTGCGGAGAGTGGTGGCCGGC GAAGGATCTGGCTCTGTGTCTCTGGCCCTGCATCTGCAGCC TCTGAGAAGCGCTGCTGGCGCTGCAGCTCTGGCACTGACA GTGGATCTGCCTCCTGCCAGCTCCGAGGCCCGGAATAGCG CATTTGGGTTTCAAGGCAGGCTGCTGCACCTGTCTGCCGGC CAGAGGCTGGGAGTGCATCTGCACACAGAGGCCAGGGCTA GACACGCCTGGCAGCTGACACAGGGCGCTACAGTGCTGGG CCTGTTCAGAGTGACCCCCGAGATTCCAGCCGGCCTGCCTT CTCCAAGAAGCGAA |
| 332 | Nucleotide sequence anti-CEA (T84.66-LCHA) light chain | see Table 82 |
| 337 | anti-CEA (T84.66-LCHA) Fc hole dimeric 41-BBL (71-254) chain | QVQLVQSGAEVKKPGSSVKVSCKASGFNIKDTYMHWVRQ APGQGLEWMGRIDPANGNSKYVPKFQGRVTITADTSTSTA YMELSSLRSEDTAVYYCAPFGYYVSDYAMAYWGQGTLV TVSSASTKGPSVFPL4PSSKSTSGGTAALGCLVKDYFPEPVTVS WNSGALTSGVHTFPAVLQSSGLYSLSSVVTVPSSSLGTQTYICNV NHKPSNTKVDKKVEPKSCDKTHTCPPCPAPEAAGGPSVFLFP PKPKDTLMISRTPEVTCVVVDVSHEDPEVKFNWYVDGVEVHN AKTKPREEQYNSTYRVVSVLTVLHQDWLNGKEYKCKVSNKAL GAPIEKTISKAKGQPREPQVCTLPPSRDELTKNQVSLSCAVKG FYPSDIAVEWESNGQPENNYKTTPPVLDSDGSFFLVSKLTVDK SRWQQGNVFSCSVMHEALHNHYTQKSLSLSPGGGGGSGGG SREGPELSPDDPAGLLDLRQGMFAQLVAQNVLLIDGPLSWYS DPGLAGVSLTGGLSYKEDTKELVVAKAGVYYVFFQLELRRVVA GEGSGSVSLALHLQPLRSAAGAAALALTVDLPPASSEARNSAFG FQGRLLHLSAGQRLGVHLHTEARARHAWQLTQGATVLGLFRV TPEIPAGLPSPRSEGGGGSGGGGSSREGPELSPDDPAGLLDLR |

TABLE 84-continued cDNA and amino acid sequences of bivalent CEA (T84.66-LCHA) targeted split trimeric 4-1BB ligand (71-254) Fc (kih) PGLALA fusion (construct 5.3)

| SEQ ID NO: | Description | Sequence |
|---|---|---|
|  |  | QGMFAQLVAQNVLLIDGPLSWYSDPGLAGVSLTGGLSYKEDT<br>KELVVAKAGVYYVFFQLELRRVVAGEGSGSVSLALHLQPLRSA<br>AGAAALALTVDLPPASSEARNSAFGFQGRLLHLSAGQRLGVHL<br>HTEARARHAWQLTQGATVLGLFRVTPEIPAGLPSPRSE |
| 338 | anti-CEA (T84.66-LCHA) Fc knob monomeric 4-1BBL (71-254) chain | QVQLVQSGAEVKKPGSSVKVSCKASGFNIKDTYMHWVRQ<br>APGQGLEWMGRIDPANGNSKYVPKFQGRVTITADTSTSTA<br>YMELSSLRSEDTAVYYCAPFGYYVSDYAMAYWGQGTLV<br>TVSSASTKGPSVFPL4PSSKSTSGGTAALGCLVKDYFPEPVTVS<br>WNSGALTSGVHTFPAVLQSSGLYSLSSVVTVPSSSLGTQTYICNV<br>NHKPSNTKVDKKVEPKSCDKTHTCPPCPAPEAAGGPSVFLFP<br>PKPKDTLMISRTPEVTCVVVDVSHEDPEVKFNWYVDGVEVHN<br>AKTKPREEQYNSTYRVVSVLTVLHQDWLNGKEYKCKVSNKAL<br>GAPIEKTISKAKGQPREPQVYTLPPCRDELTKNQVSLWCLVKG<br>FYPSDIAVEWESNGQPENNYKTTPPVLDSDGSFFLYSKLTVDK<br>SRWQQGNVFSCSVMHEALHNHYTQKSLSLSPGGGGGSGGGG<br>SREGPELSPDDPAGLLDLRQGMFAQLVAQNVLLIDGPLSWYS<br>DPGLAGVSLTGGLSYKEDTKELVVAKAGVYYVFFQLELRRVVA<br>GEGSGSVSLALHLQPLRSAAGAAALALTVDLPPASSEARNSAFG<br>FQGRLLHLSAGQRLGVHLHTEARARHAWQLTQGATVLGLFRV<br>TPEIPAGLPSPRSE |
| 334 | anti-CEA (T84.66-LCHA) light chain | see Table 82 |

11.2.4 Preparation of Monovalent CEA(T84.66-LCHA) Targeted 4-1BB Ligand (71-248) Trimer-Containing Fc (kih) Fusion Antigen Binding Molecule with Crossed CH1-CL Domains with Charged Residues (Construct 5.4)

A polypeptide containing two ectodomains of 4-1BB ligand (71-248), separated by $(G_4S)_2$ (SEQ ID NO:13) linkers, and fused to the human IgG1-CL domain, was cloned in analogy to the one depicted in FIG. 29A: human 4-1BB ligand, $(G_4S)_2$ (SEQ ID NO:13) connector, human 4-1BB ligand, $(G_4S)_2$ (SEQ ID NO:13) connector, human CL. A polypeptide containing one ectodomain of 4-1BB ligand (71-248) and fused to the human IgG1-CH domain, was cloned in analogy to the one described in FIG. 29B: human 4-1BB ligand, $(G_4S)_2$ (SEQ ID NO:13) connector, human CH.

The polypeptide encoding the dimeric 4-1BB ligand fused to human CL domain was subcloned in frame with the human IgG1 heavy chain CH2 and CH3 domains on the knob (Merchant, Zhu et al. 1998). To improve correct pairing the following mutations have been introduced in the crossed CH-CL. In the dimeric 4-1BB ligand fused to human CL, E123R and Q124K. In the monomeric 4-1BB ligand fused to human CH1, K147E and K213E.

The variable region of heavy and light chain DNA sequences encoding a binder specific for CEA, clone T84.66-LCHA, were subcloned in frame with either the constant heavy chain of the hole or the constant light chain of human IgG1. The Pro329Gly, Leu234Ala and Leu235Ala mutations have been introduced in the constant region of the knob and hole heavy chains to abrogate binding to Fc gamma receptors according to the method described in WO 2012/130831. Combination of the dimeric ligand-Fc knob chain containing the S354C/T366W mutations, the monomeric CH1 fusion, the targeted anti-CD19-Fc hole chain containing the Y349C/T366S/L368A/Y407V mutations and the anti-CD19 light chain allows generation of a heterodimer, which includes an assembled trimeric 4-1BB ligand and a CEA binding Fab (FIG. 40D, construct 5.4).

Table 85 shows the cDNA and amino acid sequences of the monovalent CEA(T84.66-LCHA) targeted split trimeric 4-1BB ligand (71-248) Fc (kih) fusion antigen binding molecule with crossed CH-CL and charged residues (construct 5.4).

TABLE 85 cDNA and amino acid sequences of monovalent CEA(T84.66-LCHA) targeted split trimeric 4-1BB ligand (71-248) Fc (kih) fusion containing CH—CL cross with charged residues (construct 5.4).

| SEQ ID NO: | Description | Sequence |
|---|---|---|
| 169 | Nucleotide sequence dimeric ligand (71-248)-CL* Fc knob chain | see Table 24 |
| 170 | Nucleotide sequence monomeric hu 4-1BBL (71-248)-CH1* | see Table 24 |
| 331 | Nucleotide sequence anti-CEA(T84.66-LCHA) Fc hole chain | see Table 82 |
| 332 | Nucleotide sequence anti-CEA(T84.66-LCHA) light chain | see Table 82 |
| 119 | Dimeric ligand (71-248)-CL* Fc knob chain | see Table 24 |
| 120 | Monomeric ligand (71-248)-CH1* | see Table 24 |
| 333 | anti-CEA(T84.66-LCHA) Fc hole chain | see Table 62 |
| 334 | anti-CEA(T84.66-LCHA) light chain | see Table 59 |

*charged residues 11.2.5 Preparation of Monovalent CEA(T84.66-LCHA) Targeted 4-1BB Ligand (71-248) Trimer-Containing Fc (kih) Fusion Antigen Binding Molecule with Crossed CH1-CL Domains without Charged Residues (Construct 5.5)

A polypeptide containing two ectodomains of 4-1BB ligand (71-248), separated by $(G_4S)_2$ (SEQ ID NO:13) linkers, and fused to the human IgG1-CL domain, was cloned in analogy as depicted in FIG. 29A), but without amino acid mutations in the CL domain: human 4-1BB ligand, (G45)2 (SEQ ID NO:13) connector, human 4-1BB ligand, (G$_4$S)$_2$ (SEQ ID NO:13) connector, human CL. A polypeptide containing one ectodomain of 4-1BB ligand (71-248) and fused to the human IgG1-CH1 domain, was cloned in analogy as depicted in FIG. 29B), but without amino acid mutations in the CH1 domain: human 4-1BB ligand, (G$_4$S)$_2$ (SEQ ID NO:13) connector, human CH1.

The variable region of heavy and light chain DNA sequences encoding a binder specific for CEA, clone T84.66-LCHA, were subcloned in frame with either the constant heavy chain of the hole or the constant light chain of human IgG1. The Pro329Gly, Leu234Ala and Leu235Ala mutations have been introduced in the constant region of the knob and hole heavy chains to abrogate binding to Fc gamma receptors according to the method described in WO 2012/130831. Combination of the dimeric ligand-Fc knob chain containing the S354C/T366W mutations, the monomeric CH1 fusion, the targeted anti-CEA-Fc hole chain containing the Y349C/T366S/L368A/Y407V mutations and the anti-CEA light chain allows generation of a heterodimer, which includes an assembled trimeric 4-1BB ligand and a CD19-binding Fab (FIG. 40E, Construct 5.5).

Table 86 shows the cDNA and amino acid sequences of the monovalent CEA(T84.66-LCHA) targeted split trimeric 4-1BB ligand (71-248) Fc (kih) fusion antigen binding molecule containing crossed CH-CL cross without charged residues (construct 5.5).

TABLE 86 cDNA and amino acid sequences of monovalent CEA(T84.66-LCHA) targeted split trimeric 4-1BB ligand (71-248) Fc (kih) fusion containing CH—CL cross without charged residues (construct 5.5).

| SEQ ID NO: | Description | Sequence |
|---|---|---|
| 171 | Nucleotide sequence dimeric ligand (71-248)-CL Fc knob chain | see Table 25 |
| 172 | Nucleotide sequence monomeric ligand (71-248)-CH1 | see Table 25 |
| 331 | Nucleotide sequence anti-CEA(T84.66-LCHA) Fc hole chain | see Table 82 |
| 332 | Nucleotide sequence anti-CEA(T84.66-LCHA) light chain | see Table 82 |

TABLE 86-continued cDNA and amino acid sequences of monovalent CEA(T84.66-LCHA) targeted split trimeric 4-1BB ligand (71-248) Fc (kih) fusion containing CH—CL cross without charged residues (construct 5.5).

| SEQ ID NO: | Description | Sequence |
|---|---|---|
| 173 | Dimeric ligand (71-248)-CL Fc knob chain | see Table 25 |
| 174 | Monomeric ligand (71-248)-CH1 | see Table 25 |
| 333 | anti-CEA(T84.66-LCHA) Fc hole chain | see Table 82 |
| 334 | anti-CEA(T84.66-LCHA) light chain | see Table 82 |

11.2.6 Preparation of Bivalent CEA(T84.66-LCHA) Targeted 4-1BB Ligand (71-248) Trimer-Containing Fc (kih) Fusion Antigen Binding (Construct 5.6)

A polypeptide containing two ectodomains of 4-1BB ligand (71-248), separated by (G$_4$S)$_2$ (SEQ ID NO:13) linkers was fused to the C-terminus of human IgG1 Fc hole chain, as depicted in FIG. 29C: human IgG1 Fc hole, (G$_4$S)$_2$ (SEQ ID NO:13) connector, human 4-1BB ligand, (G$_4$S)$_2$ (SEQ ID NO:13) connector, human 4-1BB ligand. A polypeptide containing one ectodomain of 4-1BB ligand (71-254) and fused to the C-terminus of human IgG1 Fc knob chain as described in FIG. 29D: human IgG1 Fc knob, (G$_4$S)$_2$ (SEQ ID NO:13) connector, human 4-1BB ligand.

The variable region of heavy and light chain DNA sequences encoding a binder specific for CEA, clone T84.66-LCHA, were subcloned in frame with either the constant heavy chain of the hole, the knob or the constant light chain of human IgG1. The Pro329Gly, Leu234Ala and Leu235Ala mutations have been introduced in the constant region of the knob and hole heavy chains to abrogate binding to Fc gamma receptors according to the method described in WO 2012/130831. Combination of the anti-CEA huIgG1 hole dimeric ligand chain containing the Y349C/T366S/L368A/Y407V mutations, the anti-CEA huIgG1 knob monomeric ligand chain containing the S354C/T366W mutations and the anti-CEA light chain allows generation of a heterodimer, which includes an assembled trimeric 4-1BB ligand and two CEA binding Fabs (FIG. 40F, construct 5.6).

Table 87 shows the cDNA and amino acid sequences of the bivalent CEA(T84.66-LCHA) targeted split trimeric 4-1BB ligand (71-248) Fc (kih) fusion antigen binding molecule (construct 5.6).

TABLE 87 cDNA and amino acid sequences of bivalent CEA (T84.66-LCHA) targeted split trimeric 4-1BB ligand (71-248) Fc (kih) fusion (construct 5.6)

| SEQ ID NO: | Description | Sequence |
|---|---|---|
| 339 | Nucleotide sequence anti-CEA (T84.66-LCHA) Fc hole dimeric 4-1BBL (71-248) chain | CAGGTGCAGCTGGTGCAGTCTGGCGCCGAAGTGAAGAA<br>ACCCGGCAGCAGCGTGAAGGTGTCCTGCAAGGCCAGCG<br>GCTTCAACATCAAGGACACCTACATGCACTGGGTGCGCC<br>AGGCCCCTGGACAGGGACTGGAATGGATGGGCAGAATC<br>GACCCCGCCAACGGCAACAGCAAATACGTGCCCAAGTT<br>CCAGGGCAGAGTGACCATCACCGCCGACACCAGCACCT<br>CCACCGCCTACATGGAACTGAGCAGCCTGCGGAGCGAG<br>GACACCGCCGTGTACTACTGTGCCCCCTTCGGCTACTAC<br>GTGTCCGACTACGCCATGGCCTATTGGGGCCAGGGCAC<br>ACTCGTGACCGTGTCCTCTGCTAGCACCAAGGGCCCCTC<br>CGTGTTCCCCCTGGCCCCCAGCAGCAAGAGCACCAGCG<br>GCGGCACAGCCGCTCTGGGCTGCCTGGTCAAGGACTACT<br>TCCCCGAGCCCGTGACCGTGTCCTGGAACAGCGGAGCC<br>CTGACCTCCGGCGTGCACACCTTCCCCGCCGTGCTGCAG<br>AGTTCTGGCCTGTATAGCCTGAGCAGCGTGGTCACCGTG<br>CCTTCTAGCAGCCTGGGCACCCAGACCTACATCTGCAAC<br>GTGAACCACAAGCCCAGCAACACCAAGGTGGACAAGAA |

TABLE 87-continued cDNA and amino acid sequences of bivalent CEA (T84.66-LCHA) targeted split trimeric 4-1BB ligand (71-248) Fc (kih) fusion (construct 5.6)

| SEQ ID NO: | Description | Sequence |
|---|---|---|
| | | GGTGGAGCCCAAGAGCTGCGACAAAACTCACACATGCC
CACCGTGCCCAGCACCTGAAGCTGCAGGGGGACCGTCA
GTCTTCCTCTTCCCCCCAAAACCCAAGGACACCCTCATG
ATCTCCCGGACCCCTGAGGTCACATGCGTGGTGGTGGAC
GTGAGCCACGAAGACCCTGAGGTCAAGTTCAACTGGTA
CGTGGACGGCGTGGAGGTGCATAATGCCAAGACAAAGC
CGCGGGAGGAGCAGTACAACAGCACGTACCGTGTGGTC
AGCGTCCTCACCGTCCTGCACCAGGACTGGCTGAATGGC
AAGGAGTACAAGTGCAAGGTCTCCAACAAAGCCCTCGG
CGCCCCCATCGAGAAAACCATCTCCAAAGCCAAAGGGC
AGCCCCGAGAACCACAGGTGTGCACCCTGCCCCCATCCC
GGGATGAGCTGACCAAGAACCAGGTCAGCCTCTCGTGC
GCAGTCAAAGGCTTCTATCCCAGCGACATCGCCGTGGA
GTGGGAGAGCAATGGGCAGCCGGAGAACAACTACAAGA
CCACGCCTCCCGTGCTGGACTCCGACGGCTCCTTCTTCC
TCGTGAGCAAGCTCACCGTGGACAAGAGCAGGTGGCAG
CAGGGGAACGTCTTCTCATGCTCCGTGATGCATGAGGCT
CTGCACAACCACTACACGCAGAAGAGCCTCTCCCTGTCT
CCGGGTGGAGGCGGCGAAGCGGAGGAGGAGGATCCA
GAGAGGGCCCTGAGCTGAGCCCTGATGATCCTGCCGGA
CTGCTGGACCTGCGGCAGGGAATGTTTGCCCAGCTGGTG
GCCCAGAACGTGCTGCTGATCGATGGCCCCCTGTCCTGG
TACAGCGATCCTGGACTGGCTGGCGTGTCACTGACAGGC
GGCCTGAGCTACAAAGAGGACACCAAAGAACTGGTGGT
GGCCAAGGCCGGCGTGTACTACGTGTTCTTTCAGCTGGA
ACTGCGGAGAGTGGTGGCCGGCGAAGGATCTGGCTCTG
TGTCTCTGGCCCTGCATCTGCAGCCTCTGAGATCTGCTG
CTGGCGCCGCTGCTCTGGCACTGACAGTGGATCTGCCTC
CTGCCAGCAGCGAGGCCCGGAATAGCGCATTTGGGTTTC
AAGGCAGGCTGCTGCACCTGTCTGCCGGCCAGAGGCTG
GGAGTGCATCTGCACACAGAGGCCAGGGCTAGACACGC
CTGGCAGCTGACACAGGGCGCTACAGTGCTGGGCCTGTT
CAGAGTGACCCCCGAGATTCCAGCAGGCCTGGGAGGCG
GCGGATCTGGCGGCGGAGGATCTAGAGAAGGACCCGAG
CTGTCCCCCGACGATCCCGCTGGGCTGCTGGATCTGAGA
CAGGGCATGTTCGCTCAGCTGGTGGCTCAGAATGTGCTG
CTGATTGACGGACCTCTGAGCTGGTACTCCGACCCAGGG
CTGGCAGGGGTGTCCCTGACTGGGGGACTGTCCTACAA
GAAGATACAAAAGAACTGGTGGTGGCTAAAGCTGGGGT
GTACTATGTGTTTTTTCAGCTGGAACTGAGGCGGGTGGT
GGCTGGGGAGGGCTCAGGATCTGTGTCCCTGGCTCTGCA
TCTGCAGCCACTGCGCTCTGCAGCAGGGGCTGCAGCACT
GGCCCTGACTGTGGACCTGCCCCCCAGCTTCTTCCGAGGC
CAGAAACAGCGCCTTCGGGTTCCAAGGACGCCTGCTGC
ATCTGAGCGCCGGACAGCGCCTGGGAGTGCATCTGCAT
ACTGAAGCCAGAGCCCGGCATGCTTGGCAGCTGACTCA
GGGGGCAACTGTGCTGGGACTGTTTCGCGTGACACCTGA
GATCCCAGCCGGGCTC |
| 340 | Nucleotide sequence anti-CEA (T84.66-LCHA) Fc knob monomeric (71-248) 4-1BBL chain | CAGGTGCAGCTGGTGCAGTCTGGCGCCGAAGTGAAGAA
ACCCGGCAGCAGCGTGAAGGTGTCCTGCAAGGCCAGCG
GCTTCAACATCAAGGACACCTACATGCACTGGGTGCGCC
AGGCCCCTGGACAGGGACTGGAATGGATGGGCAGAATC
GACCCCGCCAACGGCAACAGCAAATACGTGCCCAAGTT
CCAGGGCAGAGTGACCATCACCGCCGACACCAGCACCT
CCACCGCCTACATGGAACTGAGCAGCCTGCGGAGCGAG
GACACCGCCGTGTACTACTGTGCCCCCTTCGGCTACTAC
GTGTCCGACTACGCCATGGCCTATTGGGGCCAGGGCAC
ACTCGTGACCGTGTCCTCTGCTAGCACCAAGGGCCCATC
GGTCTTCCCCCTGGCACCCTCCTCCAAGAGCACCTCTGG
GGGCACAGCGGCCCTGGGCTGCCTGGTCAAGGACTACT
TCCCCGAACCGGTGACGGTGTCGTGGAACTCAGGCGCC
CTGACCAGCGGCGTGCACACCTTCCCGGCTGTCCTACAG
TCCTCAGGACTCTACTCCCTCAGCAGCGTGGTGACCGTG
CCCTCCAGCAGCTTGGGCACCCAGACCTACATCTGCAAC
GTGAATCACAAGCCCAGCAACACCAAGGTGGACAAGAA
AGTTGAGCCCAAATCTTGTGACAAAACTCACACATGCCC
ACCGTGCCCAGCACCTGAAGCTGCAGGGGGACCGTCAG
TCTTCCTCTTCCCCCCAAAACCCAAGGACACCCTCATGA
TCTCCCGGACCCCTGAGGTCACATGCGTGGTGGTGGACG
TGAGCCACGAAGACCCTGAGGTCAAGTTCAACTGGTAC
GTGGACGGCGTGGAGGTGCATAATGCCAAGACAAAGCC
GCGGGAGGAGCAGTACAACAGCACGTACCGTGTGGTCA |

TABLE 87-continued cDNA and amino acid sequences of bivalent CEA (T84.66-LCHA)
targeted split trimeric 4-1BB ligand (71-248) Fc (kih) fusion
(construct 5.6)

| SEQ ID NO: | Description | Sequence |
|---|---|---|
| | | GCGTCCTCACCGTCCTGCACCAGGACTGGCTGAATGGCA<br>AGGAGTACAAGTGCAAGGTCTCCAACAAAGCCCTCGGC<br>GCCCCCATCGAGAAAACCATCTCCAAAGCCAAAGGGCA<br>GCCCCGAGAACCACAGGTGTACACCCTGCCCCCCTGCA<br>GAGATGAGCTGACCAAGAACCAGGTGTCCCTGTGGTGT<br>CTGGTCAAGGGCTTCTACCCCAGCGATATCGCCGTGGAG<br>TGGGAGAGCAACGGCCAGCCTGAGAACAACTACAAGAC<br>CACCCCCCCTGTGCTGGACAGCGACGGCAGCTTCTTCCT<br>GTACTCCAAACTGACCGTGGACAAGAGCCGGTGGCAGC<br>AGGGCAACGTGTTCAGCTGCAGCGTGATGCACGAGGCC<br>CTGCACAACCACTACACCCAGAAGTCCCTGAGCCTGAG<br>CCCCGGCGGAGGCGGCGGAAGCGGAGGAGGAGGATCC<br>AGAGAGGGCCCTGAGCTGAGCCCTGATGATCCTGCCGG<br>ACTGCTGGACCTGCGGCAGGGAATGTTTGCCCAGCTGGT<br>GGCCCAGAACGTGCTGCTGATCGATGGCCCCCTGTCCTG<br>GTACAGCGATCCTGGACTGGCTGGCGTGTCACTGACAGG<br>CGGCCTGAGCTACAAAGAGGACACCAAAGAACTGGTGG<br>TGGCCAAGGCCGGCGTGTACTACGTGTTCTTTCAGCTGG<br>AACTGCGGAGAGTGGTGGCCGGCGAAGGATCTGGCTCT<br>GTGTCTCTGGCCCTGCATCTGCAGCCTCTGAGATCTGCT<br>GCTGGCGCCGCTGCTCTGGCACTGACAGTGGATCTGCCT<br>CCTGCCAGCAGCGAGGCCCGGAATAGCGCATTTGGGTTT<br>CAAGGCAGGCTGCTGCACCTGTCTGCCGGCCAGAGGCT<br>GGGAGTGCATCTGCACACAGAGGCCAGGGCTAGACACG<br>CCTGGCAGCTGACACAGGGCGCTACAGTGCTGGGCCTG<br>TTCAGAGTGACCCCCGAGATTCCTGCCGGGCTC |
| 332 | Nucleotide sequence anti-CEA (T84.66-LCHA) light chain | see Table 82 |
| 341 | anti-CEA (T84.66-LCHA) Fc hole dimeric 4-1BBL (71-248) chain | QVQLVQSGAEVKKPGSSVKVSCKASGFNIKDTYMHWVRQ<br>APGQGLEWMGRIDPANGNSKYVPKFQGRVTITADTSTSTA<br>YMELSSLRSEDTAVYYCAPFGYYVSDYAMAYWGQGTLV<br>TVSSASTKGPSVFPLAPSSKSTSGGTAALGCLVKDYFPEPV<br>TVSWNSGALTSGVHTFPAVLQSSGLYSLSSVVTVPSSSLGT<br>QTYICNVNHKPSNTKVDKKVEPKSCDKTHTCPPCPAPEAA<br>GGPSVFLFPPKPKDTLMISRTPEVTCVVVDVSHEDPEVKFN<br>WYVDGVEVHNAKTKPREEQYNSTYRVVSVLTVLHQDWL<br>NGKEYKCKVSNKALGAPIEKTISKAKGQPREPQVCTLPPSR<br>DELTKNQVSLSCAVKGFYPSDIAVEWESNGQPENNYKTTP<br>PVLDSDGSFFLVSKLTVDKSRWQQGNVFSCSVMHEALHN<br>HYTQKSLSLSPGGGGSGGGGSREGPELSPDDPAGLLDLR<br>QGMFAQLVAQNVLLIDGPLSWYSDPGLAGVSLTGGLSYKE<br>DTKELVVAKAGVYYVFFQLELRRVVAGEGSGSVSLALHL<br>QPLRSAAGAAAALALTVDLPPASSEARNSAFGFQGRLLHLS<br>AGQRLGVHLHTEARARHAWQLTQGATVLGLFRVTPEIPA<br>GLGGGGSGGGGSREGPELSPDDPAGLLDLRQGMFAQLVA<br>QNVLLIDGPLSWYSDPGLAGVSLTGGLSYKEDTKELVVAK<br>AGVYYVFFQLELRRVVAGEGSGSVSLALHLQPLRSAAGAA<br>ALALTVDLPPASSEARNSAFGFQGRLLHLSAGQRLGVHLH<br>TEARARHAWQLTQGATVLGLFRVTPEIPAGL |
| 342 | anti-CEA (T84.66-LCHA) Fc knob monomeric (71-248) 4-1BBL chain | QVQLVQSGAEVKKPGSSVKVSCKASGFNIKDTYMHWVRQ<br>APGQGLEWMGRIDPANGNSKYVPKFQGRVTITADTSTSTA<br>YMELSSLRSEDTAVYYCAPFGYYVSDYAMAYWGQGTLV<br>TVSSASTKGPSVFPLAPSSKSTSGGTAALGCLVKDYFPEPV<br>TVSWNSGALTSGVHTFPAVLQSSGLYSLSSVVTVPSSSLGT<br>QTYICNVNHKPSNTKVDKKVEPKSCDKTHTCPPCPAPEAA<br>GGPSVFLFPPKPKDTLMISRTPEVTCVVVDVSHEDPEVKFN<br>WYVDGVEVHNAKTKPREEQYNSTYRVVSVLTVLHQDWL<br>NGKEYKCKVSNKALGAPIEKTISKAKGQPREPQVYTLPPCR<br>DELTKNQVSLWCLVKGFYPSDIAVEWESNGQPENNYKTTP<br>PVLDSDGSFFLYSKLTVDKSRWQQGNVFSCSVMHEALHN<br>HYTQKSLSLSPGGGGSGGGGSREGPELSPDDPAGLLDLR<br>QGMFAQLVAQNVLLIDGPLSWYSDPGLAGVSLTGGLSYKE<br>DTKELVVAKAGVYYVFFQLELRRVVAGEGSGSVSLALHL<br>QPLRSAAGAAAALALTVDLPPASSEARNSAFGFQGRLLHLS<br>AGQRLGVHLHTEARARHAWQLTQGATVLGLFRVTPEIPA<br>GL |

TABLE 87-continued cDNA and amino acid sequences of bivalent CEA (T84.66-LCHA)
targeted split trimeric 4-1BB ligand (71-248) Fc (kih) fusion
(construct 5.6)

| SEQ ID NO: | Description | Sequence |
|---|---|---|
| 334 | anti-CD19 (8B8-018) light chain | see Table 82 |

11.2.7 Preparation of Monovalent CEA(T84.66) Targeted 4-1BB Ligand (71-254) Trimer-Containing Fc (kih) Fusion Antigen Binding Molecule with Crossed CH1-CL Domains with Charged Residues (Construct 5.7)

A polypeptide containing two ectodomains of 4-1BB ligand (71-254), separated by (G$_4$S)$_2$ (SEQ ID NO:13) linkers, and fused to the human IgG1-CL domain, was cloned as depicted in FIG. 29A: human 4-1BB ligand, (G$_4$S)$_2$ (SEQ ID NO:13) connector, human 4-1BB ligand, (G$_4$S)$_2$ (SEQ ID NO:13) connector, human CL. A polypeptide containing one ectodomain of 4-1BB ligand (71-254) and fused to the human IgG1-CH domain, was cloned as described in FIG. 29B: human 4-1BB ligand, (G$_4$S)$_2$ (SEQ ID NO:13) connector, human CH.

To improve correct pairing the following mutations have been introduced in the crossed CH-CL. In the dimeric 4-1BB ligand fused to human CL, E123R and Q124K. In the monomeric 4-1BB ligand fused to human CH1, K147E and K213E.

The variable region of heavy and light chain DNA sequences encoding a binder specific for CEA, clone T84.66, were subcloned in frame with either the constant heavy chain of the hole or the constant light chain of human IgG1. The Pro329Gly, Leu234Ala and Leu235Ala mutations have been introduced in the constant region of the knob and hole heavy chains to abrogate binding to Fc gamma receptors according to the method described in WO 2012/130831.

Combination of the dimeric ligand-Fc knob chain containing the S354C/T366W mutations, the monomeric CH1 fusion, the targeted anti-CD19-Fc hole chain containing the Y349C/T366S/L368A/Y407V mutations and the anti-CD19 light chain allows generation of a heterodimer, which includes an assembled trimeric 4-1BB ligand and a CEA binding Fab. Construct 5.7 corresponds to Construct 5.1 as shown in FIG. 40A.

Table 88 shows the cDNA and amino acid sequences of the monovalent CEA(T84.66) targeted split trimeric 4-1BB ligand (71-254) Fc (kih) fusion antigen binding molecule with crossed CH-CL and charged residues (construct 5.7).

TABLE 88 cDNA and amino acid sequences of monovalent CEA (T84.66) targeted
split trimeric 4-1BB ligand (71-254) Fc (kih) fusion containing
crossed CH-CL with charged residues (construct 5.7).

| SEQ ID NO: | Description | Sequence |
|---|---|---|
| 129 | Nucleotide sequence Dimeric hu 4-1BBL (71-254)-CL* Fc knob chain | see Table 3 |
| 130 | Nucleotide sequence Monomeric hu 4-1BBL (71-254)-CH1* | see Table 3 |
| 343 | Nucleotide sequence anti-CEA (T84.66) Fc hole chain | GAGGTGCAGCTGCAGCAGTCTGGCGCCGAACTGGTGGA<br>ACCTGGCGCCTCTGTGAAGCTGAGCTGTACCGCCAGCGG<br>CTTCAACATCAAGGACACCTACATGCACTGGGTCAAGC<br>AGCGGCCTGAGCAGGGCCTGGAATGGATCGGCAGAATC<br>GACCCCGCCAACGGCAACAGCAAATACGTGCCCAAGTT<br>CCAGGGCAAGGCCACCATCACCGCCGACACCAGCAGCA<br>ACACAGCCTACCTGCAGCTGACCAGCCTGACCTCCGAG<br>GACACCGCCGTGTACTACTGCGCCCCCTTCGGCTACTAC<br>GTGTCCGACTACGCCATGGCCTATTGGGGCCAGGGCAC<br>AAGCGTGACCGTGTCCTCTGCTAGCACCAAGGGCCCCTC<br>CGTGTTCCCCCTGGCCCCCAGCAGCAAGAGCACCAGCG<br>GCGGCACAGCCGCTCTGGGCTGCCTGGTCAAGGACTACT<br>TCCCCGAGCCCGTGACCGTGTCCTGGAACAGCGGAGCC<br>CTGACCTCCGGCGTGCACACCTTCCCCGCCGTGCTGCAG<br>AGTTCTGGCCTGTATAGCCTGAGCAGCGTGGTCACCGTG<br>CCTTCTAGCAGCCTGGGCACCCAGACCTACATCTGCAAC<br>GTGAACCACAAGCCCAGCAACACCAAGGTGGACAAGAA<br>GGTGGAGCCCAAGAGCTGCGACAAAACTCACACATGCC<br>CACCGTGCCCAGCACCTGAAGCTGCAGGGGGACCGTCA<br>GTCTTCCTCTTCCCCCCAAAACCCAAGGACACCCTCATG<br>ATCTCCCGGACCCCTGAGGTCACATGCGTGGTGGTGGAC |

TABLE 88-continued cDNA and amino acid sequences of monovalent CEA (T84.66) targeted
split trimeric 4-1BB ligand (71-254) Fc (kih) fusion containing
crossed CH-CL with charged residues (construct 5.7).

| SEQ ID NO: | Description | Sequence |
|---|---|---|
| | | GTGAGCCACGAAGACCCTGAGGTCAAGTTCAACTGGTA<br>CGTGGACGGCGTGGAGGTGCATAATGCCAAGACAAAGC<br>CGCGGGAGGAGCAGTACAACAGCACGTACCGTGTGGTC<br>AGCGTCCTCACCGTCCTGCACCAGGACTGGCTGAATGGC<br>AAGGAGTACAAGTGCAAGGTCTCCAACAAAGCCCTCGG<br>CGCCCCCATCGAGAAACCATCTCCAAAGCCAAAGGGC<br>AGCCCCGAGAACCACAGGTGTGCACCCTGCCCCCATCCC<br>GGGATGAGCTGACCAAGAACCAGGTCAGCCTCTCGTGC<br>GCAGTCAAAGGCTTCTATCCCAGCGACATCGCCGTGGA<br>GTGGGAGAGCAATGGGCAGCCGGAGAACAACTACAAGA<br>CCACGCCTCCCGTGCTGGACTCCGACGGCTCCTTCTTCC<br>TCGTGAGCAAGCTCACCGTGGACAAGAGCAGGTGGCAG<br>CAGGGGAACGTCTTCTCATGCTCCGTGATGCATGAGGCT<br>CTGCACAACCACTACACGCAGAAGAGCCTCTCCCTGTCT<br>CCGGGTAAA |
| 344 | Nucleotide sequence anti-CEA (T84.66) light chain | GACATCGTGCTGACCCAGAGCCCTGCCTCTCTGGCCGTG<br>TCTCTGGGACAGAGGGCCACCATGTCTTGCAGAGCCGG<br>CGAGAGCGTGGACATCTTCGGCGTGGGATTTCTGCACTG<br>GTATCAGCAGAAGCCCGGCCAGCCCCCCAAGCTGCTGA<br>TCTACAGAGCCAGCAACCTGGAAAGCGGCATCCCCGTG<br>CGGTTTAGCGGCACCGGCAGCAGAACCGACTTCACCCT<br>GATCATCGACCCCGTGGAAGCCGACGACGTGGCCACCT<br>ACTACTGCCAGCAGACCAACGAGGACCCCTACACCTTTG<br>GCGGAGGCACCAAGCTGGAAATCAAGCGTACGGTGGCT<br>GCACCATCTGTCTTCATCTTCCCGCCATCTGATGAGCAG<br>TTGAAATCTGGAACTGCCTCTGTTGTGTGCCTGCTGAAT<br>AACTTCTATCCCAGAGAGGCCAAAGTACAGTGGAAGGT<br>GGATAACGCCCTCCAATCGGGTAACTCCCAGGAGAGTG<br>TCACAGAGCAGGACAGCAAGGACAGCACCTACAGCCTC<br>AGCAGCACCCTGACGCTGAGCAAAGCAGACTACGAGAA<br>ACACAAAGTCTACGCCTGCGAAGTCACCCATCAGGGCC<br>TGAGCTCGCCCGTCACAAAGAGCTTCAACAGGGGAGAG<br>TGT |
| 115 | Dimeric hu 4-1BBL (71-254)-CL* Fc knob chain | see Table 3 |
| 116 | Monomeric hu 4-1BBL (71-254)-CH1* | see Table 3 |
| 345 | anti-CEA (T84.66) Fc hole chain | EVQLQQSGAELVEPGASVKLSCTASGFNIKDTYMHWVKQ<br>RPEQGLEWIGRIDPANGNSKYVPKFQGKATITADTSSNTAY<br>LQLTSLTSEDTAVYYCAPFGYYVSDYAMAYWGQGTSVTV<br>SSASTKGPSVFPLAPSSKSTSGGTAALGCLVKDYFPEPVTV<br>SWNSGALTSGVHTFPAVLQSSGLYSLSSVVTVPSSSLGTQT<br>YICNVNHKPSNTKVDKKVEPKSCDKTHTCPPCPAPEAAGG<br>PSVFLFPPKPKDTLMISRTPEVTCVVVDVSHEDPEVKFNWY<br>VDGVEVHNAKTKPREEQYNSTYRVVSVLTVLHQDWLNG<br>KEYKCKVSNKALGAPIEKTISKAKGQPREPQVCTLPPSRDE<br>LTKNQVSLSCAVKGFYPSDIAVEWESNGQPENNYKTTPPV<br>LDSDGSFFLVSKLTVDKSRWQQGNVFSCSVMHEALHNHY<br>TQKSLSLSPGK |
| 346 | anti-CEA (T84.66) light chain | DIVLTQSPASLAVSLGQRATMSCRAGESVDIFGVGFLHWY<br>QQKPGQPPKLLIYRASNLESGIPVRFSGTGSRTDFTLIIDPVE<br>ADDVATYYCQQTNEDPYTFGGGTKLEIKRTVAAPSVFIFPP<br>SDEQLKSGTASVVCLLNNFYPREAKVQWKVDNALQSGNS<br>QESVTEQDSKDSTYSLSSTLTLSKADYEKHKVYACEVTHQ<br>GLSSPVTKSFNRGEC |

*for charged residues

11.2.8 Preparation of Bivalent CEA(T84.66) Targeted 4-1BB Ligand (71-254) Trimer-Containing Fc (kih) Fusion Antigen Binding Molecule (Construct 5.8)

A polypeptide containing two ectodomains of 4-1BB ligand (71-254), separated by $(G_4S)_2$ (SEQ ID NO:13) linkers was fused to the C-terminus of human IgG1 Fc hole chain, as depicted in FIG. 29C: human IgG1 Fc hole, $(G_4S)_2$ (SEQ ID NO:13) connector, human 4-1BB ligand, $(G_4S)_2$ (SEQ ID NO:13) connector, human 4-1BB ligand. A polypeptide containing one ectodomain of 4-1BB ligand (71-254) and fused to the C-terminus of human IgG1 Fc knob chain as described in FIG. 29D: human IgG1 Fc knob, $(G_4S)_2$ (SEQ ID NO:13) connector, human 4-1BB ligand.

The variable region of heavy and light chain DNA sequences encoding a binder specific for CEA, clone T84.66, were subcloned in frame with either the constant heavy chain of the hole, the knob or the constant light chain of human IgG1. The Pro329Gly, Leu234Ala and Leu235Ala mutations have been introduced in the constant region of the knob and hole heavy chains to abrogate binding to Fc gamma receptors according to the method described in WO 2012/130831. Combination of the anti-CEA huIgG1 hole dimeric ligand chain containing the Y349C/T366S/L368A/Y407V mutations, the anti-CEA huIgG1 knob monomeric ligand chain containing the S354C/T366W mutations and the anti-CEA light chain allows generation of a heterodimer, which includes an assembled trimeric 4-1BB ligand and two CEA binding Fabs. Construct 5.8 corresponds to Construct 5.3 as shown in FIG. 40C.

Table 89 shows the cDNA and amino acid sequences of the bivalent CEA(T84.66) targeted split trimeric 4-1BB ligand (71-254) Fc (kih) fusion antigen binding molecule (construct 5.8).

TABLE 89 cDNA and amino acid sequences of bivalent CEA (T84.66) targeted split trimeric 4-1BB ligand (71-254) Fc (kih) PGLALA fusion (construct 5.8)

| SEQ ID NO: | Description | Sequence |
|---|---|---|
| 347 | Nucleotide sequence anti-CEA (T84.66) Fc hole dimeric 4-1BBL (71-254) chain | GAGGTGCAGCTGCAGCAGTCTGGCGCCGAACTGGTGGA ACCTGGCGCCTCTGTGAAGCTGAGCTGTACCGCCAGCGG CTTCAACATCAAGGACACCTACATGCACTGGGTCAAGC AGCGGCCTGAGCAGGGCCTGGAATGGATCGGCAGAATC GACCCCGCCAACGGCAACAGCAAATACGTGCCCAAGTT CCAGGGCAAGGCCACCATCACCGCCGACACCAGCAGCA ACACAGCCTACCTGCAGCTGACCAGCCTGACCTCCGAG GACACCGCCGTGTACTACTGCGCCCCCTTCGGCTACTAC GTGTCCGACTACGCCATGGCCTATTGGGGCCAGGGCAC AAGCGTGACCGTGTCCTCTGCTAGCACCAAGGGCCCCTC CGTGTTCCCCCTGGCCCCCAGCAGCAAGAGCACCAGCG GCGGCACAGCCGCTCTGGGCTGCCTGGTCAAGGACTACT TCCCCGAGCCCGTGACCGTGTCCTGGAACAGCGGAGCC CTGACCTCCGGCGTGCACACCTTCCCCGCCGTGCTGCAG AGTTCTGGCCTGTATAGCCTGAGCAGCGTGGTCACCGTG CCTTCTAGCAGCCTGGGCACCCAGACCTACATCTGCAAC GTGAACCACAAGCCCAGCAACACCAAGGTGGACAAGAA GGTGGAGCCCAAGAGCTGCGACAAAACTCACACATGCC CACCGTGCCCAGCACCTGAAGCTGCAGGGGGACCGTCA GTCTTCCTCTTCCCCCCAAAACCCAAGGACACCCTCATG ATCTCCCGGACCCCTGAGGTCACATGCGTGGTGGTGGAC GTGAGCCACGAAGACCCTGAGGTCAAGTTCAACTGGTA CGTGGACGGCGTGGAGGTGCATAATGCCAAGACAAAGC CGCGGGAGGAGCAGTACAACAGCACGTACCGTGTGGTC AGCGTCCTCACCGTCCTGCACCAGGACTGGCTGAATGGC AAGGAGTACAAGTGCAAGGTCTCCAACAAAGCCCTCGG CGCCCCCATCGAGAAAACCATCTCCAAAGCCAAAGGGC AGCCCCGAGAACCACAGGTGTGCACCCTGCCCCCATCCC GGGATGAGCTGACCAAGAACCAGGTCAGCCTCTCGTGC GCAGTCAAAGGCTTCTATCCCAGCGACATCGCCGTGGA GTGGGAGAGCAATGGGCAGCCGGAGAACAACTACAAGA CCACGCCTCCCGTGCTGGACTCCGACGGCTCCTTCTTCC TCGTGAGCAAGCTCACCGTGGACAAGAGCAGGTGGCAG CAGGGGAACGTCTTCTCATGCTCCGTGATGCATGAGGCT CTGCACAACCACTACACGCAGAAGAGCCTCTCCCTGTCT CCGGGTGGAGGCGGCGGAAGCGGAGGAGGAGGATCCA GAGAGGGCCCTGAGCTGAGCCCCGATGATCCTGCTGGA CTGCTGGACCTGCGGCAGGGCATGTTTGCTCAGCTGGTG GCCCAGAACGTGCTGCTGATCGATGGCCCCCTGTCCTGG TACAGCGATCCTGGACTGGCTGGCGTGTCACTGACAGGC GGCCTGAGCTACAAAGAGGACACCAAAGAACTGGTGGT GGCCAAGGCCGGCGTGTACTACGTGTTCTTTCAGCTGGA ACTGCGGAGAGTGGTGGCCGGCGAAGGATCTGCTCTG TGTCTCTGGCCCTGCATCTGCAGCCTCTGAGAAGCGCTG CTGGCGCTGCAGCTCTGGCACTGACAGTGGATCTGCCTC CTGCCAGCTCCGAGGCCCGGAATAGCGCATTTGGGTTTC AAGGCAGGCTGCTGCACCTGTCTGCCGGCCAGAGGCTG GGAGTGCATCTGCACACAGAGGCCAGGGCTAGACACGC CTGGCAGCTGACACAGGGCGCTACAGTGCTGGGCCTGTT CAGAGTGACCCCCGAGATTCCAGCCGGCCTGCCTTCTCC AAGAAGCGAAGGCGGAGGCGGATCTGGCGGCGGAGGA |

TABLE 89-continued cDNA and amino acid sequences of bivalent CEA (T84.66) targeted split trimeric 4-1BB ligand (71-254) Fc (kih) PGLALA fusion (construct 5.8)

| SEQ ID NO: | Description | Sequence |
|---|---|---|
| | | TCTAGAGAGGGACCCGAACTGTCCCCTGACGATCCAGC CGGGCTGCTGGATCTGAGACAGGGAATGTTCGCCCAGCT GGTGGCTCAGAATGTGCTGCTGATTGACGGACCTCTGAG CTGGTACTCCGACCCAGGGCTGGCAGGGGTGTCCCTGAC TGGGGGACTGTCCTACAAAGAAGATACAAAAGAACTGG TGGTGGCTAAAGCTGGGGTGTACTATGTGTTTTTTCAGC TGGAACTGAGGCGGGTGGTGGCTGGGGAGGGCTCAGGA TCTGTGTCCCTGGCTCTGCATCTGCAGCCACTGCGCTCT GCTGCTGGCGCAGCTGCACTGGCTCTGACTGTGGACCTG CCACCAGCCTCTAGCGAGGCCAGAAACAGCGCCTTCGG GTTCCAAGGACGCCTGCTGCATCTGAGCGCCGGACAGC GCCTGGGAGTGCATCTGCATACTGAAGCAGAGCCCGG CATGCTTGGCAGCTGACTCAGGGGGCAACTGTGCTGGG ACTGTTTCGCGTGACACCTGAGATCCCTGCCGGACTGCC AAGCCCTAGATCAGAA |
| 348 | Nucleotide sequence anti-CEA (T84.66) Fc knob monomeric 4-1BBL (72-254) chain | GAGGTGCAGCTGCAGCAGTCTGGCGCCGAACTGGTGGA ACCTGGCGCCTCTGTGAAGCTGAGCTGTACCGCCAGCGG CTTCAACATCAAGGACACCTACATGCACTGGGTCAAGC AGCGGCCTGAGCAGGGCCTGGAATGGATCGGCAGAATC GACCCCGCCAACGGCAACAGCAAATACGTGCCCAAGTT CCAGGGCAAGGCCACCATCACCGCCGACACCAGCAGCA ACACAGCCTACCTGCAGCTGACCAGCCTGACCTCCGAG GACACCGCCGTGTACTACTGCGCCCCCTTCGGCTACTAC GTGTCCGACTACGCCATGGCCTATTGGGGCCAGGGCAC AAGCGTGACCGTGTCCTCTGCTAGCACCAAGGGCCCATC GGTCTTCCCCCTGGCACCCTCCTCCAAGAGCACCTCTGG GGGCACAGCGGCCCTGGGCTGCCTGGTCAAGGACTACT TCCCCGAACCGGTGACGGTGTCGTGGAACTCAGGCGCC CTGACCAGCGGCGTGCACACCTTCCCGGCTGTCCTACAG TCCTCAGGACTCTACTCCCTCAGCAGCGTGGTGACCGTG CCCTCCAGCAGCTTGGGCACCCAGACCTACATCTGCAAC GTGAATCACAAGCCCAGCAACACCAAGGTGGACAAGAA AGTTGAGCCCAAATCTTGTGACAAAACTCACACATGCCC ACCGTGCCCAGCACCTGAAGCTGCAGGGGGACCGTCAG TCTTCCTCTTCCCCCCAAAACCCAAGGACACCCTCATGA TCTCCCGGACCCCTGAGGTCACATGCGTGGTGGTGGACG TGAGCCACGAAGACCCTGAGGTCAAGTTCAACTGGTAC GTGGACGGCGTGGAGGTGCATAATGCCAAGACAAAGCC GCGGGAGGAGCAGTACAACAGCACGTACCGTGTGGTCA GCGTCCTCACCGTCCTGCACCAGGACTGGCTGAATGGCA AGGAGTACAAGTGCAAGGTCTCCAACAAAGCCCTCGGC GCCCCCATCGAGAAAACCATCTCCAAAGCCAAAGGGCA GCCCCGAGAACCACAGGTGTACACCCTGCCCCCCTGCA GAGATGAGCTGACCAAGAACCAGGTGTCCCTGTGGTGT CTGGTCAAGGGCTTCTACCCCAGCGATATCGCCGTGGAG TGGGAGAGCAACGGCCAGCCTGAGAACAACTACAAGAC CACCCCCCCTGTGCTGGACAGCGACGGCAGCTTCTTCCT GTACTCCAAACTGACCGTGGACAAGAGCCGGTGGCAGC AGGGCAACGTGTTCAGCTGCAGCGTGATGCACGAGGCC CTGCACAACCACTACACCCAGAAGTCCCTGAGCCTGAG CCCCGGCGGAGGCGGCGGAAGCGGAGGAGGAGGATCC AGAGAGGGCCCTGAGCTGAGCCCCGATGATCCTGCTGG ACTGCTGGACCTGCGGCAGGGCATGTTTGCTCAGCTGGT GGCCCAGAACGTGCTGCTGATCGATGGCCCCCTGTCCTG GTACAGCGATCCTGGACTGGCTGGCGTGTCACTGACAGG CGGCCTGAGCTACAAAGAGGACACCAAAGAACTGGTGG TGGCCAAGGCCGGCGTGTACTACGTGTTCTTTCAGCTGG AACTGCGGAGAGTGGTGGCCGGCGAAGGATCTGGCTCT GTGTCTCTGGCCCTGCATCTGCAGCCTCTGAGAAGCGCT GCTGGCGCTGCAGCTCTGGCACTGACAGTGGATCTGCCT CCTGCCAGCTCCGAGGCCCGGAATAGCGCATTTGGGTTT CAAGGCAGGCTGCTGCACCTGTCTGCCGGCCAGAGGCT GGGAGTGCATCTGCACACAGAGGCCAGGGCTAGACACG CCTGGCAGCTGACACAGGGCGCTACAGTGCTGGGCCTG TTCAGAGTGACCCCCGAGATTCCAGCCGGCCTGCCTTCT CCAAGAAGCGAA |
| 344 | Nucleotide sequence anti-CEA (T84.66) light chain | see Table 88 |

TABLE 89-continued cDNA and amino acid sequences of bivalent CEA (T84.66) targeted split trimeric 4-1BB ligand (71-254) Fc (kih) PGLALA fusion (construct 5.8)

| SEQ ID NO: | Description | Sequence |
|---|---|---|
| 349 | anti-CEA (T84.66) Fc hole dimeric 4-1BBL (71-254) chain | EVQLQQSGAELVEPGASVKLSCTASGFNIKDTYMHWVKQ RPEQGLEWIGRIDPANGNSKYVPKFQGKATITADTSSNTAY LQLTSLTSEDTAVYYCAPFGYYVSDYAMAYWGQGTSVTV SSASTKGPSVFPLAPSSKSTSGGTAALGCLVKDYFPEPVTV SWNSGALTSGVHTFPAVLQSSGLYSLSSVVTVPSSSLGTQT YICNVNHKPSNTKVDKKVEPKSCDKTHTCPPCPAPEAAGG PSVFLFPPKPKDTLMISRTPEVTCVVVDVSHEDPEVKFNWY VDGVEVHNAKTKPREEQYNSTYRVVSVLTVLHQDWLNG KEYKCKVSNKALGAPIEKTISKAKGQPREPQVCTLPPSRDE LTKNQVSLSCAVKGFYPSDIAVEWESNGQPENNYKTTPPV LDSDGSFFLVSKLTVDKSRWQQGNVFSCSVMHEALHNHY TQKSLSLSPGGGGGSGGGGSREGPELSPDDPAGLLDLRQG MFAQLVAQNVLLIDGPLSWYSDPGLAGVSLTGGLSYKEDT KELVVAKAGVYYVFFQLELRRVVAGEGSGSVSLALHLQPL RSAAGAAALALTVDLPPASSEARNSAFGFQGRLLHLSAGQ RLGVHLHTEARARHAWQLTQGATVLGLFRVTPEIPAGLPS PRSEGGGGSGGGGSREGPELSPDDPAGLLDLRQGMFAQLV AQNVLLIDGPLSWYSDPGLAGVSLTGGLSYKEDTKELVVA KAGVYYVFFQLELRRVVAGEGSGSVSLALHLQPLRSAAGA AALALTVDLPPASSEARNSAFGFQGRLLHLSAGQRLGVHL HTEARARHAWQLTQGATVLGLFRVTPEIPAGLPSPRSE |
| 350 | anti-CEA (T84.66) Fc knob monomeric 4-1BBL (71-254) chain | EVQLQQSGAELVEPGASVKLSCTASGFNIKDTYMHWVKQ RPEQGLEWIGRIDPANGNSKYVPKFQGKATITADTSSNTAY LQLTSLTSEDTAVYYCAPFGYYVSDYAMAYWGQGTSVTV SSASTKGPSVFPLAPSSKSTSGGTAALGCLVKDYFPEPVTV SWNSGALTSGVHTFPAVLQSSGLYSLSSVVTVPSSSLGTQT YICNVNHKPSNTKVDKKVEPKSCDKTHTCPPCPAPEAAGG PSVFLFPPKPKDTLMISRTPEVTCVVVDVSHEDPEVKFNWY VDGVEVHNAKTKPREEQYNSTYRVVSVLTVLHQDWLNG KEYKCKVSNKALGAPIEKTISKAKGQPREPQVYTLPPCRDE LTKNQVSLWCLVKGFYPSDIAVEWESNGQPENNYKTTPPV LDSDGSFFLYSKLTVDKSRWQQGNVFSCSVMHEALHNHY TQKSLSLSPGGGGSGGGGSREGPELSPDDPAGLLDLRQG MFAQLVAQNVLLIDGPLSWYSDPGLAGVSLTGGLSYKEDT KELVVAKAGVYYVFFQLELRRVVAGEGSGSVSLALHLQPL RSAAGAAALALTVDLPPASSEARNSAFGFQGRLLHLSAGQ RLGVHLHTEARARHAWQLTQGATVLGLFRVTPEIPAGLPS PRSE |
| 346 | anti-CEA (T84.66) light chain | see Table 88 |

11.3 Preparation of Untargeted Split Trimeric 4-1BB Ligand Fc Fusion Molecules and Human IgG as Control Molecules 11.3.1 Preparation of Untargeted Human 4-1BB Ligand Trimer-Containing Fc Fusion Antigen Binding Molecules (Control Molecules)

These control molecules were prepared as described above for the CEA targeted construct 3.1 (termed control B), 3.3 (termed control C), 3.4 (termed control D) and 3.5 (termed control E) with the only difference that the anti-CD19 binder (VH-VL) was replaced by a germline control, termed DP47, not binding to the antigen (see FIGS. 40A to 40F). The cDNA and amino acid sequences of control B, the monovalent DP47-untargeted split trimeric 4-1BB ligand (71-254) Fc (kih) fusion containing crossed CH-CL with charged residues, are shown in Table 68 above (see Example 7.3.1). Table 69 shows the cDNA and amino acid sequences of the bivalent DP47-untargeted split trimeric 4-1BB ligand (71-254) Fc (kih) fusion, control C. Table 70 shows the cDNA and amino acid sequences of the monovalent DP47-untargeted split trimeric 4-1BB ligand (71-248) Fc (kih) fusion containing CH-CL cross with charged residues, control D. Table 71 shows the cDNA and amino acid sequences of the monovalent DP47-untargeted split trimeric 4-1BB ligand (71-248) Fc (kih) fusion without charged residues in the CH-CL cross, control E.

11.3.2 Antibodies as Control Molecules

An additional control used in the assays, termed control F, was an untargeted DP47, germline control, human IgG1, containing the Pro329Gly, Leu234Ala and Leu235Ala mutations, to abrogate binding to Fc gamma receptors. The cDNA and amino acid sequences of control F can be found in Table 73 above.

11.4 Production of CEA-Targeted Split Trimeric 4-1BB Ligand Fc Fusion Antigen Binding Molecules and their Control Molecules The targeted and untargeted split trimeric 4-1BB ligand Fc (kih) fusion antigen binding molecule encoding sequences were cloned into a plasmid vector, which drives expression of the insert from an MPSV promoter and contains a synthetic polyA sequence located at the 3' end of the CDS. In addition, the vector contains an EBV OriP sequence for episomal maintenance of the plasmid.

The split trimeric 4-1BB ligand Fc (kih) fusion was produced by co-transfecting HEK293-EBNA cells with the mammalian expression vectors using polyethylenimine. The cells were transfected with the corresponding expression vectors. For variants 1, 2, 4, 5 and it's control B, D and E, at a 1:1:1:1 ratio ("vector dimeric ligand-CL-knob chain": "vector monomeric ligand fusion-CH1":"vector anti-CEA Fab-hole chain":"vector anti-CEA light chain"). For variant 3, 6 and it's control C, at a 1:1:1 ratio ("vector huIgG1 Fc hole dimeric ligand chain":"vector huIgG1 Fc knob monomeric ligand chain":"vector anti-CEA light chain"). Human IgGs, used as control in the assay, were produced as for the bispecific construct (for transfection only a vector for light and a vector for heavy chain were used at a 1:1 ratio).

For production in 500 mL shake flasks, 300 million HEK293 EBNA cells were seeded 24 hours before transfection. For transfection cells were centrifuged for 10 minutes at 210×g, and the supernatant was replaced by 20 mL pre-warmed CD CHO medium. Expression vectors (200 µg of total DNA) were mixed in 20 mL CD CHO medium. After addition of 540 µL PEI, the solution was vortexed for 15 seconds and incubated for 10 minutes at room temperature. Afterwards, cells were mixed with the DNA/PEI solution, transferred to a 500 mL shake flask and incubated for 3 hours at 37° C. in an incubator with a 5% $CO_2$ atmosphere. After the incubation, 160 mL of Excell medium supplemented with 6 mM L-Glutamine, 5 g/L PEPSOY and 1.2 mM valproic acid was added and cells were cultured for 24 hours. One day after transfection 12% Feed (amino acid and glucose) were added. After culturing for 7 days, the supernatant was collected by centrifugation for 30-40 minutes at least 400×g. The solution was sterile filtered (0.22 µm filter), supplemented with sodium azide to a final concentration of 0.01% (w/v), and kept at 4° C.

The split trimeric 4-1BB ligand Fc (kih) fusion, as well as the IgG, was purified from cell culture supernatants by affinity chromatography using Protein A, followed by size exclusion chromatography. For affinity chromatography, the supernatant was loaded on a MABSELECT SURE® column (CV=5-15 mL, resin from GE Healthcare) equilibrated with Sodium Phosphate (20 mM), Sodium Citrate (20 mM) buffer (pH 7.5). Unbound protein was removed by washing with at least 6 column volumes of the same buffer. The bound protein was eluted using either a linear gradient (20 CV) or a step elution (8 CV) with 20 mM sodium citrate, 100 mM Sodium chloride, 100 mM Glycine buffer (pH 3.0). For the linear gradient an additional 4 column volumes step elution was applied.

The pH of collected fractions was adjusted by adding 1/10 (v/v) of 0.5M sodium phosphate, pH8.0. The protein was concentrated prior to loading on a HILOAD® Superdex 200 column (GE Healthcare) equilibrated with 20 mM Histidine, 140 mM sodium chloride, 0.01% (v/v) TWEEN® 20 (polysorbate 20) solution of pH 6.0.

The protein concentration was determined by measuring the optical density (OD) at 280 nm, using a molar extinction coefficient calculated on the basis of the amino acid sequence. Purity and molecular weight of the targeted trimeric 4-1BB ligand Fc (kih) fusion antigen binding molecule was analyzed by SDS-PAGE in the presence and absence of a reducing agent (5 mM 1,4-dithiothreitol) and staining with Coomassie SIMPLYBLUE™ SafeStain (Invitrogen USA) or CE-SDS using Caliper LabChip GXII (Perkin Elmer). The aggregate content of samples was analyzed using a TSKGEL® G3000 SW XL analytical size-exclusion column (Tosoh) equilibrated in 25 mM K2HPO4, 125 mM NaCl, 200 mM L-Arginine Monohydrocloride, 0.02% (w/v) NaN3, pH 6.7 running buffer at 25° C.

Table 90 summarizes the yield and final monomer content of the CEA targeted split trimeric 4-1BB ligand Fc (kih) fusion antigen binding molecules.

TABLE 90

Biochemical analysis of CEA targeted split trimeric 4-1BB ligand Fc (kih) fusion.

| Construct | Monomer [%] (SEC) | Yield [mg/l] |
|---|---|---|
| monovalent CEA(T84.66-LCHA) targeted split trimeric 4-1BB ligand (71-248) Fc fusion containing CH—CL cross with charged residues (construct 5.4) | 98 | 1.4 |
| bivalent CEA(T84.66-LCHA) targeted split trimeric 4-1BB ligand (71-248) Fc fusion (construct 5.6) | 98 | 0.4 |
| monovalent CEA(T84.66) targeted split trimeric 4-1BB ligand (71-254) Fc fusion containing CH—CL cross with charged residues (construct 5.7) | 97 | 15 |
| bivalent CEA(T84.66) targeted split trimeric 4-1BB ligand (71-254) Fc fusion (construct 5.8) | 96 | 2 |

Table 91 summarizes the yield and final monomer content of the DP47 untargeted split trimeric 4-1BB ligand Fc (kih) fusion molecules, both monovalent (control B, D and E) and bivalent (control C), and of the germline DP47 human IgG1 PGLALA (control F).

TABLE 91

Biochemical analysis of DP47 untargeted split trimeric 4-1BB ligand Fc (kih) fusion

| Construct | Monomer [%] (SEC) | Yield [mg/l] |
|---|---|---|
| monovalent DP47-untargeted split trimeric human 4-1BB ligand (71-254) Fc (kih) fusion (control B) | 99 | 15.4 |
| bivalent DP47 untargeted split trimeric human 4-1BB ligand (71-254) Fc (kih) fusion (control C) | 98 | 12.6 |
| monovalent DP47-untargeted split trimeric human 4-1BB ligand (71-254) Fc (kih) fusion (control D) | 99.5 | 25.9 |
| monovalent DP47-untargeted split trimeric human 4-1BB ligand (71-254) Fc (kih) fusion (control E) | 93.3 | 4.1 |
| germline DP47 human IgG1 PGLALA | 100 | 50 |

Example 12

Functional Characterization of the CEA Targeted 4-1BB Ligand Trimer-Containing Fc Fusion Antigen Binding Molecules 12.1 Surface Plasmon Resonance (Simultaneous Binding) Production of Hu NA3B3A2 as Antigen for CEA Targeted Trimeric Split 4-1BBL Constructs The antigen used to assess binding by SPR to CEA was a hybrid molecule composed of A3 and B3 domains from human CEACAM5 (CEA) and N and A2 domains from human CEACAM1 (BGP1) similarly to what has been described for NABA (Durbin H. et al, Proc Natl Acad Sci USA. 1994 May 10; 91(10):4313-7). The antigen is termed here NA3B3A2 and a schematic description can be found in FIG. 41A.

Table 92 shows the nucleotide and amino acid sequences of hu NA3B3A2-avi-His.

TABLE 92

Nucleotide and amino acid sequences of hu NA3B3A2-avi-His

| SEQ ID NO: | Antigen | Sequence |
|---|---|---|
| 351 | nucleotide sequence hu NA3B3A2-avi His | CAGCTGACCACCGAGTCCATGCCCTTCAACGTGGCCG<br>AGGGCAAAGAGGTGCTGCTGCTGGTCCACAACCTGCC<br>CCAGCAGCTGTTCGGCTACAGCTGGTACAAGGGCGAG<br>CGGGTGGACGGCAACCGGCAGATCGTGGGCTACGCCA<br>TCGGCACCCAGCAGGCCACACCCGGCCCTGCCAATAG<br>CGGCAGAGAGACAATCTACCCCAACGCCAGCCTGCTG<br>ATCCAGAACGTGACCCAGAACGACACCGGCTTCTACA<br>CACTCCAAGTCATCAAGAGCGACCTGGTCAACGAGGA<br>AGCCACCGGCCAGTTCCACGTGTACCCCGAGCTGCCC<br>AAGCCCAGCATCAGCAGCAACAACAGCAAGCCCGTGG<br>AAGATAAGGACGCCGTGGCCTTTACCTGCGAGCCCGA<br>GGCCCAGAACACCACCTACCTGTGGTGGGTCAACGGC<br>CAGAGCCTGCCCGTGTCCCCAGACTCCAGCTGAGCA<br>ACGGCAACAGAACCCTGACCCTGTTCAACGTGACCCG<br>GAATGACGCCAGAGCCTACGTGTGCGGCATCCAGAAC<br>AGCGTGTCCGCCAACCGCAGCGACCCCGTGACCCTGG<br>ATGTGCTGTACGGCCCCGACACCCCCATCATCAGCCCC<br>CCTGACAGCAGCTACCTGAGCGGCGCCAACCTGAACC<br>TGAGCTGCCACAGCGCCAGCAACCCCAGCCCTCAGTA<br>CAGCTGGCGGATCAACGGCATCCCCCAGCAGCACACC<br>CAGGTGCTGTTTATCGCCAAGATCACCCCCAACAACA<br>ACGGCACCTACGCCTGCTTCGTGTCCAACCTGGCCACC<br>GGCCGGAACAACAGCATCGTGAAGTCCATCACCGTGT<br>CCGCCTCCCTGAGCCCCGTGGTGGCCAAGCCTCAGAT<br>CAAGGCCAGCAAGACCACCGTGACCGGCGACAAGGA<br>CAGCGTGAACCTGACCTGCTCCACCAACGATACCGGC<br>ATCAGCATCCGGTGGTTCTTCAAGAATCAGTCCCTGCC<br>CAGCAGCGAGCGGATGAAGCTGAGCCAGGGCAACAT<br>CACCCTGTCCATCAACCCCGTGAAAAGAGAGGACGCC<br>GGCACCTATTGGTGCGAGGTGTTCAACCCCATCAGCA<br>AGAACCAGAGCGACCCCATCATGCTGAACGTGAACTA<br>CAACGCCCTGCCCCAAGAAAACCTGATCAATGTTGAT<br>CTGGAAGTGCTGTTCCAGGGCCCAGGCAGCGGCCTGA<br>ACGACATCTTCGAAGCCCAGAAAATCGAGTGGCACGA<br>GGCCAGAGCCCACCACCACCATCACCAC |
| 352 | human NA3B3A2-avi-His | QLTTESMPFNVAEGKEVLLLVHNLPQQLFGYSWYKGER<br>VDGNRQIVGYAIGTQQATPGPANSGRETIYPNASLLIQNV<br>TQNDTGFYTLQVIKSDLVNEEATGQFHVYPELPKPSISSN<br>NSKPVEDKDAVAFTCEPEAQNTTYLWWVNGQSLPVSPR<br>LQLSNGNRTLTLFNVTRNDARAYVCGIQNSVSANRSDPV<br>TLDVLYGPDTPIISPPDSSYLSGANLNLSCHSASNPSPQYS<br>WRINGIPQQHTQVLFIAKITPNNNGTYACFVSNLATGRN<br>NSIVKSITVSASLSPVVAKPQIKASKTTVTGDKDSVNLTC<br>STNDTGISIRWFFKNQSLPSSERMKLSQGNITLSINPVKRE<br>DAGTYWCEVFNPISKNQSDPIMLNVNYNALPQENLINVD<br>LEVLFQGPGSGLNDIFEAQKIEWHEARAHHHHHH |

Protein production was performed as described above for the Fc-fusion protein (Example 7.1.1). Secreted proteins were purified from cell culture supernatants by chelating chromatography, followed by size exclusion chromatography. The first chromatographic step was performed on a Ni-NTA SUPERFLOW™ Cartridge (5 ml, Qiagen) equilibrated in 20 mM sodium phosphate, 500 nM sodium chloride, pH7.4. Elution was performed by applying a gradient over 12 column volume from 5% to 45% of elution buffer (20 mM sodium phosphate, 500 nM sodium chloride, 500 mM Imidazole, pH7.4).

The protein was concentrated and filtered prior to loading on a HILOAD® Superdex 75 column (GE Healthcare) equilibrated with 20 mM Histidine, 140 mM NaCl, 0.01% TWEEN® 20 (polysorbate 20) pH 6.0. Table 93 summarizes the yield and final monomer content of human NA3B3A2-avi-His.

TABLE 93

Biochemical analysis of human NA3B3A2-avi-His

| Construct | Monomer [%] (SEC) | Yield [mg/l] |
|---|---|---|
| human NA3B3A2-avi-His | 88 | 14.1 |

The capacity of binding simultaneously human 4-1BB Fc (kih) and human NA3B3A2 was assessed by surface plasmon resonance (SPR). All SPR experiments were performed on a BIACORE® T200 instrument at 25° C. with HBS-EP as running buffer (0.01 M HEPES pH 7.4, 0.15 M NaCl, 3 mM EDTA, 0.005% Surfactant P20, Biacore, Freiburg/Germany). Biotinylated human 4-1BB Fc (kih) was directly coupled to a flow cell of a streptavidin (SA) sensor chip. Immobilization levels up to 250 resonance units (RU) were used.

The CEA targeted trimeric split 4-1BBL constructs (constructs 5.4, 5.6, 5.7 and 5.8) were passed at a concentration range of 200 nM with a flow of 30 μL/minute through the flow cells over 90 seconds and dissociation was set to zero seconds. Human NA3B3A2 was injected as second analyte with a flow of 30 μL/minute through the flow cells over 90 seconds at a concentration of 500 nM (FIG. 41B). The dissociation was monitored for 120 seconds. Bulk refractive index differences were corrected for by subtracting the response obtained in a reference flow cell, where no protein was immobilized.

As can be seen in the graphs of FIGS. 42A to 42D, all bispecific constructs could bind simultaneously human 4-1BB and human NA3B3A2.

12.2. Binding on Activated Human PMBCs of the CEA-Targeted 4-1BB Ligand Trimer-Containing Fc (kih) Fusion Antigen Binding Molecules To determine binding of 4-1BBL trimer-containing Fc fusion antigen binding molecules to human PBMCs, different titrated concentrations of the CEA-targeted 4-1BBL trimer-containing Fc fusion antigen binding molecules were used in the assay as described in Example 5.2.

FIGS. 43A to 43D show the binding of Constructs 5.4, 5.6, 5.7 and 5.8 as prepared in Example 11 on activated 4-1BB-expressing CD4+ T cells and CD8+ T cells, respectively. Gates were set on living CD45+ CD3+ CD4+ or CD45+ CD3+ CD8+ T cells and MFI of PE-conjugated AffiniPure anti-human IgG IgG Fcγ-fragment-specific goat F(ab') 2 fragment were blotted against the titrated concentration of targeted split trimeric 4-1BB ligand Fc fusion variants. Table 94 shows the $EC_{50}$ values as measured for Constructs 5.4, 5.6, 5.7 and 5.8 and control molecules.

TABLE 94

Binding on activated 4-1BB-expressing CD4+ T cells and CD8+ T cells

| Construct | $EC_{50}$ [nM] 4-1BB$^+$CD8$^+$ | $EC_{50}$ [nM] 4-1BB$^+$CD4$^+$ |
| --- | --- | --- |
| Control B | 0.05 | 0.26 |
| Control C | 0.02 | 0.30 |
| Control D | 0.04 | 0.28 |
| Control E | 0.13 | 1.22 |
| 5.4 | 0.13 | 0.35 |
| 5.6 | 0.06 | 0.34 |
| 5.7 | 0.0004 | 0.36 |
| 5.8 | 0.17 | 0.38 |

12.2 Binding to CEA-Expressing Tumor Cells

For binding assays on CEA-expressing tumor cells, the following human CEA-expressing lymphoma cell lines were used: CEA-expressing tumor cell lines human gastric cancer cell line MKN-45 (ATCC TCP-1008) and human colorectal adenocarcinoma cell line LS180 (ATCC CL-187). The assays were preformed as described for the FAP-expressing MV-3 and WM-266-4 tumor cell lines in Example 5.3.

Gates were set on living tumor cells and MFI of PE-conjugated AffiniPure anti-human IgG IgG Fcγ-fragment-specific goat F(ab')2 fragment were blotted against the titrated concentration of targeted split trimeric 4-1BB ligand Fc fusion constructs.

FIGS. 44A and 44B shows the binding of Constructs 5.7 as prepared in Example 11.2.7 to human-CEA expressing human gastric cell line MKN-45 (44A) and human colorectal adenocarcinoma cells line LS180 (44B). Table 95 shows the $EC_{50}$ values as measured for human-CEA expressing human gastric cell line MKN-45.

TABLE 95

Binding to CEA-expressing tumor cells

| Construct | $EC_{50}$ [nM] MKN45-8 | $EC_{50}$ [nM] LS180 |
| --- | --- | --- |
| 5.7 | 11.6 | 14.4 |

Example 13

Biological Activity of the CEA-Targeted 4-1BB Ligand Trimer-Containing Fc Fusion Antigen Binding Molecules 13.1. NF-κB Activation in HeLa Cells Expressing Human 4-1BB HeLa cells expressing human 4-1BB and NF-κB-luciferase were generated as described in Example 6.1.

NF-κB Activation in Hela Cells Expressing Human 4-1BB Co-Cultured with Human CEA-Expressing Tumor Cells NF-κB-luciferase human-4-1BB HeLa cells were harvested and resuspended in DMEM medium supplied with 10% (v/v) FBS and 1% (v/v) GlutaMAX-I to a concentration of $0.2 \times 10^6$ cells/ml. 100 μl ($2 \times 10^4$ cells) of this cell suspension were transferred to each well of a sterile white 96-well flat bottom tissue culture plate with lid (greiner bio-one, Cat. No. 655083) and the plate were incubated at 37° C. and 5% $CO_2$ overnight. The next day 50 μL of medium containing titrated concentrations of CEA-targeted 4-1BB ligand trimer-containing Fc fusion antigen binding molecules (CEA split 4-1BBL trimer) or DP47-untargeted 4-1BB ligand trimer-containing Fc fusion antigen binding molecules (DP47 split 4-1BBL trimer) were added. CEA-expressing tumor cell lines human gastric cancer cell line MKN-45 (ATCC TCP-1008) was resuspended in DMEM medium supplied with 10% (v/v) FBS and 1% (v/v) GlutaMAX-I to a concentration of $2 \times 10^6$ cells/ml.

Suspension of CEA-expressing B cell lymphoma cell (50 final ratio 1:5) or only medium were added to each well and plates were incubated for 6 hours at 37° C. and 5% $CO_2$. Cells were washed two times with 200 μL/well DPBS. 40 μl freshly prepared Reporter Lysis Buffer (Promega, Cat-No: E3971) were added to each well and the plate were stored over night at −20° C. The next day frozen cell plate and Detection Buffer (Luciferase 1000 Assay System, Promega, Cat. No. E4550) were thawed at room temperature. 100 μL of detection buffer were added to each well and luciferase activity was measured as fast as possible using a SpectraMax M5/M5e microplate reader and a SoftMax Pro Software (Molecular Devices) counting light emission in URL (units of released light for 0.5s/well) or Victor3 1420 multilabel counter plate reader (Perkin Elmer) and the Perkin Elmer 2030 Manager Software counting light emission as counts per seconds (CPS) and blotted against the concentration of tested constructs.

CEA-targeted 4-1BB ligand trimer-containing Fc fusion antigen binding molecules Constructs 5.7 and 5.8 triggered activation of the NF-kB signaling pathway in the reporter cell line in the presence of human gastric cancer cell line MKN-45 cells. In contrast, the untargeted control molecules failed to trigger such an effect at any of the tested concentrations (FIGS. 45A to 45D). Table 96 shows the corresponding EC50 values.

TABLE 96

Binding to CEA-expressing tumor cells

| Construct | EC$_{50}$ [nM] MKN-45 no tumor cells | EC$_{50}$ [nM] MKN45 |
|---|---|---|
| 5.4 | 3.1 | 0.34 |
| 5.6 | 2.05 | 0.21 |
| 5.7 | 0.85 | 0.05 |
| 5.8 | 1.52 | 0.45 |

Example 14

14.1 Preparation of FAP Targeted OX40 Ligand Trimer-Containing Fc Fusion Antigen Binding Molecules The DNA sequence encoding part of the ectodomain (amino acids 51-183) of human OX40 ligand was synthesized according to the P23510 sequence of Uniprot database. To decrease heterogeneity of human OX40 ligand due to glycosylation asparagine residues at position 90 and 114 were mutated to aspartic acid by site-directed mutagenesis (according to Compaan D. M., Hymowitz S. G., Structure (2006) 14(8), 1321-30).

A polypeptide containing two ectodomains of OX40 ligand, separated by (G$_4$S) (SEQ ID NO:13) linkers, and fused to the human IgG1-CL domain, was cloned as depicted in FIG. 46A: human OX40 ligand, (G$_4$S)$_2$ (SEQ ID NO:13) connector, human OX40 ligand, (G$_4$S)$_2$ (SEQ ID NO:13) connector, human CL.

A polypeptide containing one ectodomain of OX40 ligand and fused to the human IgG1-CH domain, was cloned as described in FIG. 46B: human OX40 ligand, (G$_4$S)$_2$ (SEQ ID NO:13) connector, human CH.

To improve correct pairing the following mutations have been introduced in the crossed CH-CL. In the dimeric 4-1BB ligand fused to human CL, E123R and Q124K. In the monomeric 4-1BB ligand fused to human CH1, K147E and K213E.

The generation and preparation of the FAP binders is described in WO 2012/020006 A2, which is incorporated herein by reference.

The variable region of heavy and light chain DNA sequences encoding a binder specific for FAP, clone 28H11, were subcloned in frame with either the constant heavy chain of the hole or the constant light chain of human IgG1. The Pro329Gly, Leu234Ala and Leu235Ala mutations have been introduced in the constant region of the knob and hole heavy chains to abrogate binding to Fc gamma receptors according to the method described in WO 2012/130831.

Combination of the dimeric ligand-Fc knob chain containing the S354C/T366W mutations, the monomeric CH1 fusion, the targeted anti-FAP-Fc hole chain containing the Y349C/T366S/L368A/Y407V mutations and the anti-FAP light chain allows generation of a heterodimer, which includes an assembled trimeric OX40 ligand and a FAP binding Fab (FIG. 46C, Construct 6.1).

Table 97 shows the cDNA and amino acid sequences of the monovalent CEA (T84.66-LCHA) targeted split trimeric OX40 ligand (51-183) Fc (kih) fusion antigen binding molecule with crossed CH-CL and charged residues (construct 6.1).

TABLE 97 cDNA and amino acid sequences of monovalent FAP (28H1) targeted split trimeric OX40 ligand Fc (kih) fusion containing CH-CL cross with charged residues (construct 6.1).

| SEQ ID NO: | Description | Sequence |
|---|---|---|
| 353 | Nucleotide sequence Dimeric hu OX40L (51-183)-CL* Fc knob chain | CAGGTGTCCCACAGATACCCCAGAATCCAGAGCATCAA GGTGCAGTTCACCGAGTACAAGAAAGAGAAGGGCTTCA TCCTGACCAGCCAGAAAGAGGACGAGATCATGAAGGTG CAGGACAACAGCGTGATCATCAACTGCGACGGCTTCTA CCTGATCAGCCTGAAGGGCTACTTCAGCCAGGAAGTGG ACATCAGCCTGCACTACCAGAAGGACGAGGAACCCCTG TTCCAGCTGAAGAAAGTGCGGAGCGTGAACAGCCTGAT GGTGGCCAGCCTGACCTACAAGGACAAGGTGTACCTGA ACGTGACCACCGACAACACCAGCCTGGACGACTTCCAC GTGAACGGCGGCGAGCTGATCCTGATTCACCAGAACCC CGGCGAGTTCTGCGTGCTGGGAGGCGGAGGATCTGGCG GAGGCGGATCTCAGGTGTCACACCGCTACCCCCGGATTC AGTCCATTAAGGTGCAGTTTACAGAGTATAAGAAAGAA AAAGGCTTTATTCTGACTTCCCAGAAAGAAGATGAGATT ATGAAGGTGCAGGATAATTCTGTGATCATCAATTGTGAC GGCTTCTACCTGATCAGCCTGAAGGGCTACTTCAGCCAG GAAGTGGACATCAGCCTGCACTACCAGAAGGACGAGGA ACCCCTGTTCCAGCTGAAGAAAGTGCGGAGCGTGAACA GCCTGATGGTGGCCAGCCTGACCTACAAGGACAAGGTG TACCTGAACGTGACCACCGACAACACCAGCCTGGACGA CTTCCACGTGAACGGCGGCGAGCTGATCCTGATCCACCA GAACCCTGGCGAGTTCTGCGTGCTGGGAGGCGGAGGCT CCGGAGGGGGAGGATCTCGTACGGTGGCTGCACCATCT GTCTTTATCTTCCCACCCAGCGACCGGAAGCTGAAGTCT GGCACAGCCAGCGTCGTGTGCCTGCTGAATAACTTCTAC CCCCGCGAGGCCAAGGTGCAGTGGAAGGTGGACAATGC CCTGCAGAGCGGCAACAGCCAGGAAAGCGTGACCGAGC AGGACAGCAAGGACTCCACCTACAGCCTGAGCAGCACC CTGACCCTGAGCAAGGCCGACTACGAGAAGCACAAGGT GTACGCCTGCGAAGTGACCCACCAGGGCCTGTCTAGCCC CGTGACCAAGAGCTTCAACCGGGGCGAGTGCGACAAGA CCCACACCTGTCCTCCATGCCCTGCCCCTGAAGCTGCTG GCGGCCCTAGCGTGTTCCTGTTCCCCCCAAAGCCCAAGG |

TABLE 97-continued cDNA and amino acid sequences of monovalent FAP (28H1) targeted split trimeric OX40 ligand Fc (kih) fusion containing CH-CL cross with charged residues (construct 6.1).

| SEQ ID NO: | Description | Sequence |
|---|---|---|
| | | ACACCCTGATGATCAGCCGGACCCCTGAAGTGACCTGC<br>GTGGTGGTGGATGTGTCCCACGAGGACCCTGAAGTGAA<br>GTTCAATTGGTACGTGGACGGCGTGGAAGTGCACAATG<br>CCAAGACCAAGCCGCGGGAGGAGCAGTACAACAGCACG<br>TACCGTGTGGTCAGCGTCCTCACCGTCCTGCACCAGGAC<br>TGGCTGAATGGCAAGGAGTACAAGTGCAAGGTCTCCAA<br>CAAAGCCCTCGGCGCCCCCATCGAGAAAACCATCTCCA<br>AAGCCAAAGGGCAGCCCCGAGAACCACAGGTGTACACC<br>CTGCCCCCATGCCGGGATGAGCTGACCAAGAACCAGGT<br>CAGCCTGTGGTGCCTGGTCAAAGGCTTCTATCCCAGCGA<br>CATCGCCGTGGAGTGGGAGAGCAATGGGCAGCCGGAGA<br>ACAACTACAAGACCACGCCTCCCGTGCTGGACTCCGAC<br>GGCTCCTTCTTCCTCTACAGCAAGCTCACCGTGGACAAG<br>AGCAGGTGGCAGCAGGGGAACGTCTTCTCATGCTCCGTG<br>ATGCATGAGGCTCTGCACAACCACTACACGCAGAAGAG<br>CCTCTCCCTGTCTCCGGGTAAA |
| 354 | Nucleotide sequence Monomeric hu OX40L (51-183)- CH1* | CAGGTGTCCCACAGATACCCCAGAATCCAGAGCATCAA<br>GGTGCAGTTCACCGAGTACAAGAAAGAGAAGGGCTTCA<br>TCCTGACCAGCCAGAAAGAGGACGAGATCATGAAGGTG<br>CAGGACAACAGCGTGATCATCAACTGCGACGGCTTCTA<br>CCTGATCAGCCTGAAGGGCTACTTCAGCCAGGAAGTGG<br>ACATCAGCCTGCACTACCAGAAGGACGAGGAACCCCTG<br>TTCCAGCTGAAGAAAGTGCGGAGCGTGAACAGCCTGAT<br>GGTGGCCAGCCTGACCTACAAGGACAAGGTGTACCTGA<br>ACGTGACCACCGACAACACCAGCCTGGACGACTTCCAC<br>GTGAACGGCGGCGAGCTGATCCTGATTCACCAGAACCC<br>CGGCGAGTTCTGCGTGCTGGGAGGCGGAGGTTCCGGAG<br>GCGGAGGATCTGCTAGCACAAAGGGCCCCAGCGTGTTC<br>CCTCTGGCCCCTAGCAGCAAGAGCACATCGGCGGAAC<br>AGCCGCCCTGGGCTGCCTGGTGGAAGATTACTTCCCCGA<br>GCCCGTGACCGTGTCCTGGAATTCTGGCGCCCTGACAAG<br>CGGCGTGCACACCTTTCCAGCCGTGCTGCAGAGCAGCG<br>GCCTGTACTCTCTGAGCAGCGTCGTGACAGTGCCCAGCA<br>GCTCTCTGGGCACCCAGACCTACATCTGCAACGTGAACC<br>ACAAGCCCAGCAACACCAAGGTGGACGAGAAGGTGGA<br>ACCCAAGTCCTGC |
| 68 | Nucleotide sequence anti-FAP (28H1) Fc hole chain | see Table 2 |
| 69 | Nucleotide sequence anti-FAP (28H1) light chain | see Table 2 |
| 355 | Dimeric hu OX40L (51-183)- CL* Fc knob chain | QVSHRYPRIQSIKVQFTEYKKEKGFILTSQKEDEIMKVQDN<br>SVIINCDGFYLISLKGYFSQEVDISLHYQKDEEPLFQLKKVR<br>SVNSLMVASLTYKDKVYLNVTTDNTSLDDFHVNGGELILI<br>HQNPGEFCVLGGGGSGGGGSQVSHRYPRIQSIKVQFTEYK<br>KEKGFILTSQKEDEIMKVQDNSVIINCDGFYLISLKGYFSQE<br>VDISLHYQKDEEPLFQLKKVRSVNSLMVASLTYKDKVYLN<br>VTTDNTSLDDFHVNGGELILIHQNPGEFCVLGGGGSGGGG<br>SRTVAAPSVFIFPPSDRKLKSGTASVVCLLNNFYPREAKVQ<br>WKVDNALQSGNSQESVTEQDSKDSTYSLSSTLTLSKADYE<br>KHKVYACEVTHQGLSSPVTKSFNRGECDKTHTCPPCPAPE<br>AAGGPSVFLFPPKPKDTLMISRTPEVTCVVVDVSHEDPEVK<br>FNWYVDGVEVHNAKTKPREEQYNSTYRVVSVLTVLHQD<br>WLNGKEYKCKVSNKALGAPIEKTISKAKGQPREPQVYTLP<br>PCRDELTKNQVSLWCLVKGFYPSDIAVEWESNGQPENNYK<br>TTPPVLDSDGSFFLYSKLTVDKSRWQQGNVFSCSVMHEAL<br>HNHYTQKSLSLSPGK |
| 356 | Monomeric hu OX40L (51-183)- CH1* | QVSHRYPRIQSIKVQFTEYKKEKGFILTSQKEDEIMKVQDN<br>SVIINCDGFYLISLKGYFSQEVDISLHYQKDEEPLFQLKKVR<br>SVNSLMVASLTYKDKVYLNVTTDNTSLDDFHVNGGELILI<br>HQNPGEFCVLGGGGSGGGGSASTKGPSVFPLAPSSKSTSGG<br>TAALGCLVEDYFPEPVTVSWNSGALTSGVHTFPAVLQSSG<br>LYSLSSVVTVPSSSLGTQTYICNVNHKPSNTKVDEKVEPKSC |

TABLE 97-continued cDNA and amino acid sequences of monovalent FAP (28H1) targeted
split trimeric OX40 ligand Fc (kih) fusion containing CH-CL cross
with charged residues (construct 6.1).

| SEQ ID NO: | Description | Sequence |
|---|---|---|
| 18 | anti-FAP (28H1) Fc hole chain | see Table 2 |
| 19 | anti-FAP (28H1) light chain | see Table 2 |

*for charged residues 14.2 Preparation of Untargeted Human IgG1 as Control F

A control molecule used in the assays, termed control F (FIG. 46D), was an untargeted DP47, germline control, human IgG1, containing the Pro329Gly, Leu234Ala and Leu235Ala mutations, to abrogate binding to Fc gamma receptors according to the method described in International Patent Appl. Publ. No. WO 2012/130831). Its preparation is described in Example 2.3, Table 29 shows the cDNA and amino acid sequences of the cDNA and amino acid sequences of the untargeted DP47 huIgG1 PGLALA (Control F).

14.3 Production of FAP-Targeted Split Trimeric OX40 Ligand Fc Fusion Antigen Binding Molecules and their Control Molecules The targeted and untargeted split trimeric OX40 ligand Fc (kih) fusion encoding sequences were cloned into a plasmid vector, which drives expression of the insert from an MPSV promoter and contains a synthetic polyA sequence located at the 3' end of the CDS. In addition, the vector contains an EBV OriP sequence for episomal maintenance of the plasmid.

The split trimeric OX40 ligand Fc (kih) fusion was produced by co-transfecting HEK293-EBNA cells with the mammalian expression vectors using polyethylenimine. The cells were transfected with the corresponding expression vectors. For variants 1, 2, 4, 5 and it's control B, D and E, at a 1:1:1:1 ratio ("vector dimeric ligand-CL-knob chain": "vector monomeric ligand fusion-CH1":"vector anti-FAP Fab-hole chain":"vector anti-FAP light chain"). For variant 3, 6 and it's control C, at a 1:1:1 ratio ("vector huIgG1 Fc hole dimeric ligand chain":"vector huIgG1 Fc knob monomeric ligand chain":"vector anti-FAP light chain"). Human IgGs, used as control in the assay, were produced as for the bispecific construct (for transfection only a vector for light and a vector for heavy chain were used at a 1:1 ratio).

For production in 500 mL shake flasks, 300 million HEK293 EBNA cells were seeded 24 hours before transfection. For transfection cells were centrifuged for 10 minutes at 210×g, and the supernatant was replaced by 20 mL pre-warmed CD CHO medium. Expression vectors (200 µg of total DNA) were mixed in 20 mL CD CHO medium. After addition of 540 µL PEI, the solution was vortexed for 15 seconds and incubated for 10 minutes at room temperature. Afterwards, cells were mixed with the DNA/PEI solution, transferred to a 500 mL shake flask and incubated for 3 hours at 37° C. in an incubator with a 5% CO2 atmosphere. After the incubation, 160 mL of Excell medium supplemented with 6 mM L-Glutamine, 5 g/L PEPSOY and 1.2 mM valproic acid was added and cells were cultured for 24 hours. One day after transfection 12% Feed (amino acid and glucose) were added. After culturing for 7 days, the supernatant was collected by centrifugation for 30-40 minutes at least 400×g. The solution was sterile filtered (0.22 µm filter), supplemented with sodium azide to a final concentration of 0.01% (w/v), and kept at 4° C.

The split trimeric OX40 ligand Fc (kih) fusion antigen binding molecule, as well as the IgG, was purified from cell culture supernatants by affinity chromatography using Protein A, followed by size exclusion chromatography. For affinity chromatography, the supernatant was loaded on a MABSELECT SURE® column (CV=5-15 mL, resin from GE Healthcare) equilibrated with Sodium Phosphate (20 mM), Sodium Citrate (20 mM) buffer (pH 7.5). Unbound protein was removed by washing with at least 6 column volumes of the same buffer. The bound protein was eluted using either a linear gradient (20 CV) or a step elution (8 CV) with 20 mM sodium citrate, 100 mM Sodium chloride, 100 mM Glycine buffer (pH 3.0). For the linear gradient an additional 4 column volumes step elution was applied.

The pH of collected fractions was adjusted by adding 1/10 (v/v) of 0.5M sodium phosphate, pH8.0. The protein was concentrated prior to loading on a HILOAD® Superdex 200 column (GE Healthcare) equilibrated with 20 mM Histidine, 140 mM sodium chloride, 0.01% (v/v) TWEEN® 20 (polysorbate 20) solution of pH 6.0.

The protein concentration was determined by measuring the optical density (OD) at 280 nm, using a molar extinction coefficient calculated on the basis of the amino acid sequence. Purity and molecular weight of the targeted trimeric 4-1BB ligand Fc (kih) fusion was analyzed by SDS-PAGE in the presence and absence of a reducing agent (5 mM 1,4-dithiothreitol) and staining with Coomassie SIMPLYBLUE™ SafeStain (Invitrogen USA) or CE-SDS using Caliper LabChip GXII (Perkin Elmer). The aggregate content of samples was analyzed using a TSKGEL® G3000 SW XL analytical size-exclusion column (Tosoh) equilibrated in 25 mM K2HPO4, 125 mM NaCl, 200 mM L-Arginine Monohydrocloride, 0.02% (w/v) NaN3, pH 6.7 running buffer at 25° C.

Table 98 summarizes the yield and final monomer content of the FAP targeted split trimeric OX40 ligand Fc (kih) fusion antigen binding molecule, and of the germline DP47 human IgG1 PGLALA (control F).

TABLE 98

Biochemical analysis of OX40 targeted split trimeric 4-1BB ligand Fc (kih) fusion.

| Construct | Monomer [%] (SEC) | Yield [mg/l] |
|---|---|---|
| monovalent FAP(28H1) targeted split trimeric OX40 ligand Fc fusion containing CH—CL cross with charged residues (construct 6.1) | 93.8 | 19.7 |
| germline DP47 human IgG1 PGLALA | 100 | 50 |

Example 15

Functional Characterization of the Targeted OX40 Ligand Trimer-Containing Fc Fusion Antigen Binding Molecule 15.1 Binding to Human FAP-Expressing Tumor Cells The binding to cell surface FAP was tested using WM-266-4 cells (ATCC CRL-1676). 0.5×105 WM-266-4 cells were added to each well of a round-bottom suspension cell 96-well plates (greiner bio-one, cellstar, Cat. No. 650185). Cells were stained for 120 minutes at 4° C. in the dark in 50 μL/well 4° C. cold FACS buffer (DPBS (Gibco by Life Technologies, Cat. No. 14190 326) w/ BSA (0.1% v/w, Sigma-Aldrich, Cat. No. A9418) containing titrated anti-OX40 antibody construct. After three times washing with excess FACS buffer, cells were stained for 45 minutes at 4° C. in the dark in 25 μL/well 4° C. cold FACS buffer containing Fluorescein isothiocyanate (FITC)-conjugated AffiniPure anti-human IgG Fcγ-fragment-specific goat IgG F(ab')2 fragment (Jackson ImmunoResearch, Cat. No. 109 096 098).

Plates were finally resuspended in 90 μL/well FACS-buffer containing 0.2 μg/mL DAPI (Santa Cruz Biotec, Cat. No. Sc-3598) and acquired the same day using 5-laser LSR-FORTESSA® (BD Bioscience with DIVA software).

As shown in FIG. 47A, the monovalent FAP(28H1) targeted split trimeric OX40 ligand Fc (kih) fusion antigen binding molecule (FAP-OX40L) but not the negative control F efficiently bound to human FAP-expressing target cells. EC50 values of binding to FAP positive WM-266-4 was [6.9 nM].

15.2 Binding to OX40 and FAP Negative Tumor Cells

The lack of binding to OX40 negative FAP negative tumor cells was tested using A549 NucLight™ Red Cells (Essenbioscience, Cat. No. 4491) expressing the NucLight™ Red fluorescent protein restricted to the nucleus to allow separation from unlabeled human FAP positive WM266-4 cells. Parental A549 (ATCC CCL-185) were transduced with the Essen CellPlayer NucLight™ Red Lentivirus (Essenbioscience, Cat. No. 4476; EF1α, puromycin) at an MOI of 3 (TU/cell) in the presence of 8 μg/ml polybrene following the standard Essen protocol.

A mixture of 5×104 unlabeled WM266-4 cells and unlabeled A549 NucLight™ Red Cells in FACS buffer were added to each well of a round-bottom suspension cell 96-well plates and binding assay was performed as described in section 15.1.

As shown in FIG. 47B, FAP-OX40L did not bind to OX40 negative FAP negative human tumor cells.

15.3 Binding to Human OX40 Expressing Cells: Naïve and Activated Human Peripheral Mononuclear Blood Leukocytes (PBMCs)

Buffy coats were obtained from the Zurich blood donation center. To isolate fresh peripheral blood mononuclear cells (PBMCs) the buffy coat was diluted with the same volume of DPBS (Gibco by Life Technologies, Cat. No. 14190 326). 50 mL polypropylene centrifuge tubes (TPP, Cat.-No. 91050) were supplied with 15 mL HISTOPAQUE® reagent 1077 (SIGMA Life Science, Cat.-No. 10771, polysucrose and sodium diatrizoate, adjusted to a density of 1.077 g/mL) and the buffy coat solution was layered above the HISTOPAQUE® reagent 1077. The tubes were centrifuged for 30 min at 400×g, room temperature and with low acceleration and no break. Afterwards the PBMCs were collected from the interface, washed three times with DPBS and resuspended in T cell medium consisting of RPMI 1640 medium (Gibco by Life Technology, Cat. No. 42401-042) supplied with 10% Fetal Bovine Serum (FBS, Gibco by Life Technology, Cat. No. 16000-044, Lot 941273, gamma-irradiated, mycoplasma-free and heat inactivated at 56° C. for 35 min), 1% (v/v) GlutaMAX I (GIBCO by Life Technologies, Cat. No. 35050 038), 1 mM Sodium-Pyruvat (SIGMA, Cat. No. S8636), 1% (v/v) MEM non-essential amino acids (SIGMA, Cat.-No. M7145) and 50 μM β-Mercaptoethanol (SIGMA, M3148).

PBMCs were used directly after isolation (binding on resting human PBMCs) or they were stimulated to receive a strong human OX40 expression on the cell surface of T cells (binding on activated human PBMCs). Therefore naïve PBMCs were cultured for four days in T cell medium supplied with 200 U/mL Proleukin (Novartis) and 2 ug/mL PHA-L (Sigma-Aldrich, L2769-10) in 6-well tissue culture plate and then over night on pre-coated 6-well tissue culture plates [4 ug/mL] anti-human CD3 (clone OKT3, eBioscience, Ca. No. 16-0037-85) and [2 ug/mL] anti-human CD28 (clone CD28.2, eBioscience, Cat No. 16-0289-85] in T cell medium supplied with 200 U/mL Proleukin at 37° C. and 5% CO$_2$.

For detection of OX40 naïve human PBMC and activated human PBMC were mixed. To enable distinction of naïve from activated human PBMC naïve cells were labeled prior to the binding assay using the EFLUOR® 670 cell proliferation dye (eBioscience, Cat.-No. 65-0840-85).

For labeling cells were harvested, washed with pre-warmed (37° C.) DPBS and adjusted to a cell density of 1×10$^7$ cells/mL in DPBS. EFLUOR® 670 cell proliferation dye (eBioscience, Cat.-No. 65-0840-85) was added to the suspension of naïve human PBMC at a final concentration of 2.5 mM and a final cell density of 0.5×10$^7$ cells/mL in DPBS. Cells were then incubated for 10 min at room temperature in the dark. To stop labeling reaction 4 mL heat inactivated FBS were added and cells were washed three times with T cell medium. A two to one mixture of 1×10$^5$ resting EFLUOR®670 labeled human PBMC and 0.5×10$^5$ unlabeled activated human PBMC were then added to each well of a round-bottom suspension cell 96-well plates (greiner bio-one, cellstar, Cat. No. 650185).

Cells were stained for 120 minutes at 4° C. in the dark in 50 μL/well 4° C. cold FACS buffer containing titrated anti-OX40 constructs. After three times washing with excess FACS buffer, cells were stained for 45 minutes at 4° C. in the dark in 25 μL/well 4° C. cold FACS buffer containing a mixture of fluorescently labeled anti-human CD4 (clone RPA-T4, mouse IgG1 k, BioLegend, Cat.-No. 300532), anti-human CD8 (clone RPA-T8, mouse IgG1k, BioLegend, Cat.-No. 3010441) and Fluorescein isothiocyanate (FITC)-conjugated AffiniPure anti-human IgG Fcγ-fragment-specific goat IgG F(ab')$_2$ fragment (Jackson ImmunoResearch, Cat.-No. 109-096-098).

Plates were finally resuspended in 90 µL/well FACS-buffer containing 0.2 µg/mL DAPI (Santa Cruz Biotec, Cat. No. Sc-3598) and acquired the same day using 5-laser LSR-FORTESSA® (BD Bioscience with DIVA software).

As shown in FIGS. 48A-1 and 48A-2 and 48B-1 to 48B-2, FAP-OX40L did not bind to resting human CD4+ T-cells or CD8+ T-cells, which are negative for OX40. In contrast, FAP-OX40L bound to activated CD8+ or CD4+ T-cells, which do express OX40. Binding to CD4+ T-cells was much stronger than that to CD8+ T cells. Activated human CD8+ T cells do express only a fraction of the OX40 levels detected on activated CD4+ T cells. Expression levels for OX40 are depending on kinetic and strength of stimulation and conditions were here optimized for OX40 expression on CD4+ T cells but not for CD8+ T cells. Thus, only little OX40 expression was induced on CD8 T cells. The EC 50 value of binding to OX40 positive CD4+ or CD8+ T cells was [0.15 nM].

15.4 NFκB Activation in HeLa Cells Expressing Human OX40 and Reporter Gene NFκB-Luciferase Agonstic binding o OX40 to its ligand induces downstream signaling via activation of nuclear factor kappa B (NFκB) (A. D. Weinberg et al., J. Leukoc. Biol. 2004, 75(6), 962-972). The recombinant reporter cell line HeLa_hOx40_NFkB_Luc1 was generated to express human OX40 on its surface. Additionally, it harbors a reporter plasmid containing the luciferase gene under the control of an NFκB-sensitive enhancer segment. OX40 triggering induces dose-dependent activation of NFκB, which translocates in the nucleus, where it binds on the NFκB sensitive enhancer of the reporter plasmid to increase expression of the luciferase protein. Luciferase catalyzes luciferin-oxidation resulting in oxyluciferin which emits light. This can be quantified by a luminometer. Thus, the capacity of the various anti-OX40 molecules to induce NFκB activation in HeLa_hOx40_NFkB_Luc1 reporter cells was analyzed as a measure for bioactivity.

Adherent HeLa_hOx40_NFkB_Luc1 cells were harvested using cell dissociation buffer (Invitrogen, Cat.-No. 13151-014) for 10 minutes at 37° C. Cells were washed once with DPBS and were adjusted to a cell density of $1.33 \times 10^5$ in assay media comprising of MEM (Invitrogen, Cat.-No. 22561-021), 10% (v/v) heat-inactivated FBS, 1 mM Sodium-Pyruvat and 1% (v/v) non-essential amino acids. Cells were seeded in a density of $0.2 \times 10^5$ cells per well in a sterile white 96-well flat bottom tissue culture plate with lid (greiner bio-one, Cat. No. 655083) and kept over night at 37° C. and 5% $CO_2$ in an incubator (Hera Cell 150).

The next day, HeLa_hOx40_NFkB_Luc1 were stimulated for 5 hours by adding assay medium containing titrated FAP-OX40L or negative control F. For testing the effect of hyper-crosslinking on anti-OX40 antibodies, 25 µL/well of medium containing secondary antibody anti-human IgG Fcγ-fragment-specific goat IgG F(ab')$_2$ fragment (Jackson ImmunoResearch, 109-006-098) were added in a 1:2 ratio (2 times more secondary antibody than the primary antibody). After incubation, supernatant was aspirated and plates washed two times with DPBS. Quantification of light emission was done using the luciferase 100 assay system and the reporter lysis buffer (both Promega, Cat.-No. E4550 and Cat-No: E3971) according to manufacturer instructions. Briefly, cells were lysed for 10 minutes at −20° C. by addition of 30 uL per well 1× lysis buffer. Cells were thawed for 20 minutes at 37° C. before 90 uL per well provided luciferase assay reagent was added. Light emission was quantified immediately with a SpectraMax M5/M5e microplate reader (Molecular Devices, USA) using 500 ms integration time, without any filter to collect all wavelengths. Emitted relative light units (URL) were corrected by basal luminescence of HeLa_hOx40_NFkB_Luc1 cells and were blotted against the logarithmic primary antibody concentration using Prism4 (GraphPad Software, USA). Curves were fitted using the inbuilt sigmoidal dose response.

Figure 49A:
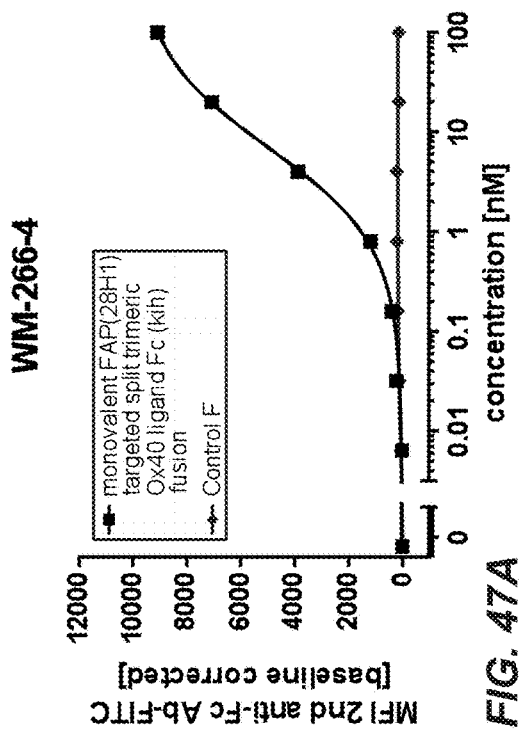
Figure 49B:
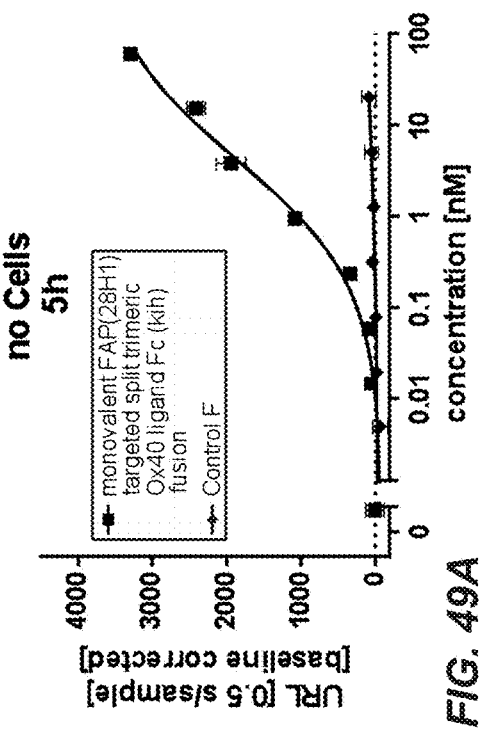

As shown in FIGS. 49A and 49B, a limited, dose dependent NFkB activation was induced already by addition of FAP-OX40L (49A) to the reporter cell line. Hyper-crosslinking of FAP-OX40L by anti-human IgG specific secondary antibodies increased the induction of NFκB-mediated luciferase-activation in a concentration-dependent manner (49B).

Consequently, we tested the NFkB activating capacity of FAP-OX40L with hyper-crosslinking of the constructs by FAP+ tumor cell lines.

Tested tumor cell line was NIH/3T3-huFAP clone 39. NIH/3T3-huFAP clone 39 was generated by the transfection of the mouse embryonic fibroblast NIH/3T3 cell line (ATCC CRL-1658) with the expression vector pETR4921 to express huFAP under 1.5 µg/mL Puromycin selection. The surface expression of FAP was quantified using the Quifikit (Dako Cat. No. K0078) according to manufactures instructions. The primary antibody used to detect cell surface FAP expression was the human/mouse crossreactive clone F11-24 (mouse IgG1, Calbiochem, Ca. No. OP188). The surface expression on NIH/3T3-huFAP clone 39 was app. 90000 huFAP per cell.

As described herein before, adherent HeLa_hOx40_NFkB_Luc1 cells were cultured over night at a cell density of $0.2 \times 10^5$ cells per well and were stimulated for 5 hours with assay medium containing titrated FAP-OX40L. To test the effect of hyper-crosslinking by cell surface FAP binding 25 µL/well of medium containing FAP+ tumor cells NIH/3T3-huFAP clone 39 were co-cultured in a 3 to 1 ratio (three times as much FAP+ tumor cells than reporter cells per well). Activated NFκB was quantified by measuring light emission using luciferase 100 assay system and the reporter lysis buffer (both Promega, Cat.-No. E4550 and Cat-No: E3971.

As shown in FIG. 50A, the presence of FAP-expressing tumor cells strongly increased induction of NFκB-mediated luciferase-activation when FAP-OX40L was added. Area under the curve of the respective blotted dose-response curves was quantified as a marker for the agonistic capacity of each construct. As shown in FIG. 50B, the presence of cell surface presented FAP ensured higher cross-linking and thus a better agonistic effect of FAP-OX40L then addition of an Fc specific secondary antibody.

15.5 OX40 Mediated Costimulation of Suboptimally TCR Triggered Resting Human PBMC and Hypercrosslinking by Cell Surface FAP It was shown in Example 15.4 that addition of FAP+ tumor cells can strongly increase the NFkB activity induced by FAP targeted OX40L in a human OX40 positive reporter cell lines by providing strong oligomerization of OX40 receptors. Likewise, we tested FAP-OX40L constructs in the presence of NIH/3T3-huFAP clone 39 cells for their ability to rescue suboptimal TCR stimulation of resting human PBMC cells.

Human PBMC preparations contain (1) resting OX40 negative CD4+ and CD8+ T cells and (2) antigen presenting cells with various Fc-γ receptor molecules on their cell surface e.g. B cells and monocytes. Anti-human CD3 antibody of human IgG1 isotype can bind with its Fc part to the present Fc-γ receptor molecules and mediate a prolonged TCR activation on resting OX40 negative CD4+ and CD8+

T cells. These cells then start to express OX40 within several hours. Functional agonistic compounds against OX40 can signal via the OX40 receptor present on activated CD8+ and CD4+ T cells and support TCR-mediated stimulation.

Resting CFSE-labeled human PBMC were stimulated for five days with a suboptimal concentration of anti-CD3 antibody in the presence of irradiated FAP+ NIH/3T3-huFAP clone 39 cells and titrated FAP-OX40L. Effects on T-cell survival and proliferation were analyzed through monitoring of total cell counts and CFSE dilution in living cells by flow cytometry.

Mouse embryonic fibroblast NIH/3T3-huFAP clone 39 cells (see Example 15.4) were harvested using cell dissociation buffer (Invitrogen, Cat.-No. 13151-014) for 10 minutes at 37° C. Cells were washed once with DPBS. NIH/3T3-huFAP clone 39 cells were cultured at a density of $0.2*10^5$ cells per well in T cell media in a sterile 96-well round bottom adhesion tissue culture plate (TPP, Cat. No. 92097) over night at 37° C. and 5% $CO_2$ in an incubator (Hera Cell 150). The next day they were irradiated in an xRay irradiator using a dose of 4500 RAD to prevent later overgrowth of human PBMC by the tumor cell line.

Human PBMCs were isolated by ficoll density centrifugation as described in Example 15.3. Cells were then labeled with CFSE at a cell density of $1 \times 10^6$ cells/mL with CFDA-SE (Sigma-Aldrich, Cat.-No. 2188) at a final concentration of [50 nM] for 10 minutes at 37° C. Thereafter, cells were washed twice with excess DPBS containing FBS (10% v/v). Labeled cells were rested in T-cell media at 37° C. for 30 minutes. Thereafter, non-converted CFDA-SE was removed by two additional washing steps with DPBS.CFSE labeled resting human PBMC were added to each well at a density of $0.5*10^5$ cells per well. Anti-human CD3 antibody (clone V9, human IgG1, described in Rodrigues et al., Int J Cancer Suppl 7, 45-50 (1992) and U.S. Pat. No. 6,054,297) at a final concentration of [20 nM] and FAP-OX40L were added at the indicated concentrations. Cells were activated for five days at 37° C. and 5% $CO_2$ in an incubator (Hera Cell 150). Then, Cells were surface-stained with fluorescent dye-conjugated antibodies anti-human CD4 (clone RPA-T4, BioLegend, Cat.-No. 300532) and CD8 (clone RPa-T8, BioLegend, Cat.-No. 3010441) for 20 min at 4° C. After a washing step with FACS buffer, cells were resuspended in 85 µL/well FACS buffer and acquired using a 5-laser FORTESSA® flow cytometer (BD Bioscience with DIVA software).

As shown in FIGS. 51A to 51D, hyper-crosslinking of FAP-OX40L constructs by the present NIH/3T3-huFAP clone 39 cells strongly promoted proliferation (see "Events" graphs, 51A and 51B) and survival (see "proliferation" graphs, 51C and 51D) in TCR stimulated human CD4 and CD8 T cells. In line with a lower expression of OX40 on human CD8+ T cells the agonistic effect of FAP-OX40L was less strong on CD8+ T cells than on CD4+ T cells.

CITATIONS

Ascierto, P. A., E. Simeone, M. Sznol, Y. X. Fu, and I. Melero (2010), Clinical experiences with anti-CD137 and anti-PD1 therapeutic antibodies. Semin Oncol 37:508-516.

Aggarwal B. B. (2003), Signalling pathways of the TNF superfamily: a double-edged sword. Nat. Rev. Immunol. 3(9), 745-56.

Banner D. et al (1993), Crystal structure of the soluble human 55 kd TNF receptor-human TNF beta complex: implications for TNF receptor activation. Cell 73, 431-445.

Bodmer J., Schneider P. and Tschopp, J. (2002), The molecular architecture of the TNF superfamily. Trends in Biochemical Sciences 27(1), 19-26.

Broll, K., Richter, G., Pauly, S., Hofstaedter, F., and Schwarz, H. (2001). CD137 expression in tumor vessel walls. High correlation with malignant tumors. Am J Clin Pathol 115, 543-549.

Buechele, C., Baessler, T., Schmiedel, B. J., Schumacher, C. E., Grosse-Hovest, L., Rittig, K., and Salih, H. R. (2012). 4-1BB ligand modulates direct and Rituximab-induced NK-cell reactivity in chronic lymphocytic leukemia. Eur J Immunol 42, 737-748.

Choi, B. K., Kim, Y. H., Kwon, P. M., Lee, S. C., Kang, S. W., Kim, M. S., Lee, M. J., and Kwon, B. S. (2009). 4-1BB functions as a survival factor in dendritic cells. J Immunol 182, 4107-4115.

Cuadros, C., Dominguez, A. L., Lollini, P. L., Croft, M., Mittler, R. S., Borgstrom, P., and Lustgarten, J. (2005). Vaccination with dendritic cells pulsed with apoptotic tumors in combination with anti-OX40 and anti-4-1BB monoclonal antibodies induces T cell-mediated protective immunity in Her-2/neu transgenic mice. Int J Cancer 116, 934-943.

Curran, M. A., Kim, M., Montalvo, W., Al-Shamkhani, A., and Allison, J. P. (2011). Combination CTLA-4 blockade and 4-1BB activation enhances tumor rejection by increasing T-cell infiltration, proliferation, and cytokine production. PLoS One 6, e19499.

Diehl, L., van Mierlo, G. J., den Boer, A. T., van der Voort, E., Fransen, M., van Bostelen, L., Krimpenfort, P., Melief, C. J., Mittler, R., Toes, R. E., and Offringa, R. (2002). In vivo triggering through 4-1BB enables Th-independent priming of CTL in the presence of an intact CD28 costimulatory pathway. J Immunol 168, 3755-3762.

Dubrot, J., Milheiro, F., Alfaro, C., Palazon, A., Martinez-Forero, I., Perez-Gracia, J. L., Morales-Kastresana, A., Romero-Trevejo, J. L., Ochoa, M. C., Hervas-Stubbs, S., et al. (2010). Treatment with anti-CD137 mAbs causes intense accumulations of liver T cells without selective antitumor immunotherapeutic effects in this organ. Cancer Immunol Immunother 59, 1223-1233.

Futagawa, T., Akiba, H., Kodama, T., Takeda, K., Hosoda, Y., Yagita, H., and Okumura, K. (2002). Expression and function of 4-1BB and 4-1BB ligand on murine dendritic cells. Int Immunol 14, 275-286.

Guo, Z., Cheng, D., Xia, Z., Luan, M., Wu, L., Wang, G., and Zhang, S. (2013). Combined TIM-3 blockade and CD137 activation affords the long-term protection in a murine model of ovarian cancer. J Transl Med 11, 215.

Heinisch, I. V., Daigle, I., Knopfli, B., and Simon, H. U. (2000). CD137 activation abrogates granulocyte-macrophage colony-stimulating factor-mediated anti-apoptosis in neutrophils. Eur J Immunol 30, 3441-3446.

Hornig, N., Kermer, V., Frey, K., Diebolder, P., Kontermann, R. E., Mueller, D. (2012), Combination of a bispecific antibody and costimulatory antibody-ligand fusion proteins for targeted cancer immunotherapy. J. Immunother. 35, 418-429.

Ju, S. A., Cheon, S. H., Park, S. M., Tam, N. Q., Kim, Y. M., An, W. G., and Kim, B. S. (2008). Eradication of established renal cell carcinoma by a combination of 5-fluorouracil and anti-4-1BB monoclonal antibody in mice. Int J Cancer 122, 2784-2790.

Kienzle, G., and von Kempis, J. (2000). CD137 (ILA/4-1BB), expressed by primary human monocytes, induces monocyte activation and apoptosis of B lymphocytes. Int Immunol 12, 73-82.

Kim, D. H., Chang, W. S., Lee, Y. S., Lee, K. A., Kim, Y. K., Kwon, B. S., and Kang, C. Y. (2008). 4-1BB engagement costimulates NKT cell activation and exacerbates NKT cell ligand-induced airway hyperresponsiveness and inflammation. J Immunol 180, 2062-2068.

Kim, Y. H., Choi, B. K., Oh, H. S., Kang, W. J., Mittler, R. S., and Kwon, B. S. (2009). Mechanisms involved in synergistic anticancer effects of anti-4-1BB and cyclophosphamide therapy. Mol Cancer Ther 8, 469-478.

Kwon, B. S., and Weissman, S. M. (1989). cDNA sequences of two inducible T-cell genes. Proc Natl Acad Sci USA 86, 1963-1967.

Lee, H., Park, H. J., Sohn, H. J., Kim, J. M., and Kim, S. J. (2011). Combinatorial therapy for liver metastatic colon cancer: dendritic cell vaccine and low-dose agonistic anti-4-1BB antibody co-stimulatory signal. J Surg Res 169, e43-50.

Levitsky, V., de Campos-Lima, P. O., Frisan, T., and Masucci, M. G. (1998). The clonal composition of a peptide-specific oligoclonal CTL repertoire selected in response to persistent EBV infection is stable over time. J Immunol 161, 594-601.

Li, F., and Ravetch, J. V. (2011). Inhibitory Fcgamma receptor engagement drives adjuvant and anti-tumor activities of agonistic CD40 antibodies. Science 333, 1030-1034.

Lin, W., Voskens, C. J., Zhang, X., Schindler, D. G., Wood, A., Burch, E., Wei, Y., Chen, L., Tian, G., Tamada, K., et al. (2008). Fc-dependent expression of CD137 on human NK cells: insights into "agonistic" effects of anti-CD137 monoclonal antibodies. Blood 112, 699-707.

Melero, I., Johnston, J. V., Shufford, W. W., Mittler, R. S., and Chen, L. (1998). NK1.1 cells express 4-1BB (CDw137) costimulatory molecule and are required for tumor immunity elicited by anti-4-1BB monoclonal antibodies. Cell Immunol 190, 167-172.

Melero, I., Shuford, W. W., Newby, S. A., Aruffo, A., Ledbetter, J. A., Hellstrom, K. E., Mittler, R. S., and Chen, L. (1997). Monoclonal antibodies against the 4-1BB T-cell activation molecule eradicate established tumors. Nat Med 3, 682-685.

Merchant, A. M., Zhu, Z., Yuan, J. Q., Goddard, A., Adams, C. W., Presta, L. G., and Carter, P. (1998). An efficient route to human bispecific IgG. Nat Biotechnol 16, 677-681.

Morales-Kastresana, A., Sanmamed, M. F., Rodriguez, I., Palazon, A., Martinez-Forero, I., Labiano, S., Hervas-Stubbs, S., Sangro, B., Ochoa, C., Rouzaut, A., et al. (2013). Combined immunostimulatory monoclonal antibodies extend survival in an aggressive transgenic hepatocellular carcinoma mouse model. Clin Cancer Res 19, 6151-6162.

Mueller, D., Frey, K., Kontermann, R. E. (2008), A novel antibody-4-1BB1 fusion protein for targeted costimulation in cancer immunotherapy, J. Immunother. 31, 714-722.

Murillo, O., Dubrot, J., Palazon, A., Arina, A., Azpilikueta, A., Alfaro, C., Solano, S., Ochoa, M. C., Berasain, C., Gabari, I., et al. (2009). In vivo depletion of DC impairs the anti-tumor effect of agonistic anti-CD137 mAb. Eur J Immunol 39, 2424-2436.

Narazaki, H., Zhu, Y., Luo, L., Zhu, G., and Chen, L. (2010). CD137 agonist antibody prevents cancer recurrence: contribution of CD137 on both hematopoietic and nonhematopoietic cells. Blood 115, 1941-1948.

Nishimoto, H., Lee, S. W., Hong, H., Potter, K. G., Maeda-Yamamoto, M., Kinoshita, T., Kawakami, Y., Mittler, R. S., Kwon, B. S., Ware, C. F., et al. (2005). Costimulation of mast cells by 4-1BB, a member of the tumor necrosis factor receptor superfamily, with the high-affinity IgE receptor. Blood 106, 4241-4248.

Olofsson, P. S., Soderstrom, L. A., Wagsater, D., Sheikine, Y., Ocaya, P., Lang, F., Rabu, C., Chen, L., Rudling, M., Aukrust, P., et al. (2008). CD137 is expressed in human atherosclerosis and promotes development of plaque inflammation in hypercholesterolemic mice. Circulation 117, 1292-1301.

Palazon, A., Teijeira, A., Martinez-Forero, I., Hervas-Stubbs, S., Roncal, C., Penuelas, I., Dubrot, J., Morales-Kastresana, A., Perez-Gracia, J. L., Ochoa, M. C., et al. (2011). Agonist anti-CD137 mAb act on tumor endothelial cells to enhance recruitment of activated T lymphocytes. Cancer Res 71, 801-811.

Schwarz, H., Valbracht, J., Tuckwell, J., von Kempis, J., and Lotz, M. (1995). ILA, the human 4-1BB homologue, is inducible in lymphoid and other cell lineages. Blood 85, 1043-1052.

Shao, Z., and Schwarz, H. (2011). CD137 ligand, a member of the tumor necrosis factor family, regulates immune responses via reverse signal transduction. J Leukoc Biol 89, 21-29.

Shi, W., and Siemann, D. W. (2006). Augmented antitumor effects of radiation therapy by 4-1BB antibody (BMS-469492) treatment. Anticancer Res 26, 3445-3453.

Simeone, E., and Ascierto, P. A. (2012). Immunomodulating antibodies in the treatment of metastatic melanoma: the experience with anti-CTLA-4, anti-CD137, and anti-PD1. J Immunotoxicol 9, 241-247.

Snell, L. M., Lin, G. H., McPherson, A. J., Moraes, T. J., and Watts, T. H. (2011). T-cell intrinsic effects of GITR and 4-1BB during viral infection and cancer immunotherapy. Immunol Rev 244, 197-217.

Stagg, J., Loi, S., Divisekera, U., Ngiow, S. F., Duret, H., Yagita, H., Teng, M. W., and Smyth, M. J. (2011). Anti-ErbB-2 mAb therapy requires type I and II interferons and synergizes with anti-PD-1 or anti-CD137 mAb therapy. Proc Natl Acad Sci USA 108, 7142-7147.

Teng, M. W., Sharkey, J., McLaughlin, N. M., Exley, M. A., and Smyth, M. J. (2009). CD1d-based combination therapy eradicates established tumors in mice. J Immunol 183, 1911-1920.

von Kempis, J., Schwarz, H., and Lotz, M. (1997). Differentiation-dependent and stimulus-specific expression of ILA, the human 4-1BB-homologue, in cells of mesenchymal origin. Osteoarthritis Cartilage 5, 394-406.

Wei, H., Zhao, L., Li, W., Fan, K., Qian, W., Hou, S., Wang, H., Dai, M., Hellstrom, I., Hellstrom, K. E., and Guo, Y. (2013). Combinatorial PD-1 blockade and CD137 activation has therapeutic efficacy in murine cancer models and synergizes with cisplatin. PLoS One 8, e84927.

Wilcox, R. A., Chapoval, A. I., Gorski, K. S., Otsuji, M., Shin, T., Flies, D. B., Tamada, K., Mittler, R. S., Tsuchiya, H., Pardoll, D. M., and Chen, L. (2002). Cutting edge: Expression of functional CD137 receptor by dendritic cells. J Immunol 168, 4262-4267.

Wilcox, R. A., Tamada, K., Flies, D. B., Zhu, G., Chapoval, A. I., Blazar, B. R., Kast, W. M., and Chen, L. (2004). Ligation of CD137 receptor prevents and reverses established anergy of CD8+ cytolytic T lymphocytes in vivo. Blood 103, 177-184.

Zhang, N., Sadun, R. E., Arias, R. S., Flanagan, M. L., Sachsman, S. M., Nien, Y, Khawli, L. A., Hu, P., Epstein, A. L. (2007). Targeted and untargeted CD137L fusion proteins for the immunotherapy of experimental solid tumors. Clin. Cancer Res. 13, 2758-2767.

Zhang, X., Voskens, C. J., Sallin, M., Maniar, A., Montes, C. L., Zhang, Y., Lin, W., Li, G., Burch, E., Tan, M., et al. (2010). CD137 promotes proliferation and survival of human B cells. J Immunol 184, 787-795.

SEQUENCE LISTING (375 sequences)

SEQ ID NO: 1 - protein, 184 aa, Homo sapiens
REGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 2 - protein, 170 aa, Homo sapiens
LDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 3 - protein, 175 aa, Homo sapiens
DPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 4 - protein, 203 aa, Homo sapiens
PWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 5 - protein, 378 aa, Artificial sequence
  hu 4-1BBL (71-254) connected by (G4S)2 to hu 4-1BBL (71-254)
REGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 6 - protein, 194 aa, Artificial sequence
  hu 4-1BBL (71-254) plus (G4S)2
REGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGS

SEQ ID NO: 7 - protein, 5 aa, Artificial Sequence
  FAP(28H1) CDR-H1
SHAMS

SEQ ID NO: 8 - protein, 16 aa, Artificial Sequence
  FAP(28H1) CDR-H2
AIWASGEQYYADSVKG

SEQ ID NO: 9 - protein, 8 aa, Artificial sequence
  FAP(28H1) CDR-H3
GWLGNFDY

SEQ ID NO: 10 - protein, 12 aa, Artificial sequence
  FAP(28H1) CDR-L1
RASQSVSRSYLA

SEQ ID NO: 11 - protein, 7 aa, Artificial sequence
  FAP(28H1) CDR-L2
GASTRAT

SEQ ID NO: 12 - protein, 9 aa, Artificial sequence
  FAP(28H1) CDR-L3
QQGQVIPPT

SEQ ID NO: 13 - protein, 10 aa, Artificial sequence
  (G4S)2 peptide linker
GGGGSGGGGS

SEQ ID NO: 14 - protein, 718 aa, Artificial sequence
  dimeric hu 4-1BBL (71-254) plus CH1 plus Fc knob chain
REGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15 - protein, 301 aa, Artificial Sequence
  hu 4-1BBL (71-254) -CL
REGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16 - protein, 116 aa, Artificial sequence
  FAP(28H1) VH
EVQLLESGGGLVQPGGSLRLSCAASGFTFSSHAMSWVRQAPGKGLEWVSAIWASGEQYYADSVKGRFTISRDNSKNTLYLQMNSLRAEDTAVYYCAKGWLGNFDYWGQGTLVTVSS

SEQ ID NO: 17 - protein, 108 aa, Artificial sequence
  FAP(28H1) VL
EIVLTQSPGTLSLSPGERATLSCRASQSVSRSYLAWYQQKPGQAPRLLIIGASTRATGIPDRFSGSGSGTDFTLTISRLEPEDFAVYYCQQGQVIPPTFGQGTKVEIK

SEQ ID NO: 18 - protein, 446 aa, Artificial sequence
  FAP(28H1) heavy chain Fc hole
EVQLLESGGGLVQPGGSLRLSCAASGFTFSSHAMSWVRQAPGKGLEWVSAIWASGEQYYADSVKGRFTISRDNSKNTLYLQMNSLRAEDTAVYYCAKGWLGNFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 19 - protein, 215 aa, Artificial sequence
  FAP(28H1) light chain
EIVLTQSPGTLSLSPGERATLSCRASQSVSRSYLAWYQQKPGQAPRLLIIGASTRATGIPDRFSGSGSGTDFTLTISRLEPEDFAVYYCQQGQVIPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20 - protein, 760 aa, Homo sapiens
MKTWVKIVFGVATSAVLALLVMCIVLRPSRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPVVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEEYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSD

SEQ ID NO: 21 - protein, 748 aa, Artificial sequence
  hu FAP ectodomain+poly-lys-tag+his6-tag
RPSRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPVVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEEYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSDGKKKKKKGHHHHHH

SEQ ID NO: 22 - DNA, 2244 bp, Artificial sequence
  hu FAP ectodomain+poly-lys-tag+his6-tag
cgcccttcaagagttcataactctgaagaaaatacaatgagagcactcacactgaaggatattttaaatggaacattttcttataaaacattttttccaaactggatttcaggacaagaatatcttcatcaatctgcagataacaatatagtactttataatattgaaacaggacaatcatataccattttgagtaatagaaccatgaaaagtgtgaatgcttcaaattacggcttatcacctgatcggcaatttgtatatctagaaagtgattattcaaagctttggagatactcttacacagcaacatattacatctatgaccttagcaatggagaatttgtaagaggaaatgagcttcctcgtccaattcagtatttatgctggtcgcctgttgggagtaaattagcatatgtctatcaaaacaatatctatttgaaacaaagaccaggagatccaccttttcaaataacatttaatggaagagaaaataaaatatttaatggaatcccagactgggtttatgaagaggaaatgcttgctacaaaatatgctctctggtggtctcctaatggaaaatttttggcatatgcggaatttaatgatacggatataccagttattgcctattcctattatggcgatgaacaatatcctagaacaataaatattccatacccaaaggctggagctaagaatcccgttgttcggatatttattatcgataccacttaccctgcgtatgtaggtccccaggaagtgcctgttccagcaatgatagcctcaagtgattattatttcagttggctcacgtgggttactgatgaacgagtatgtttgcagtggctaaaaagagtccagaatgtttcggtcctgtctatatgtgacttcagggaagactggcagacatgggattgtccaaagacccaggagcatatagaagaaagcagaactggatgggctggtggattctttgtttcaacaccagttttcagctatgatgccatttcgtactacaaaatatttagtgacaaggatggctacaaacatattcactatatcaaagacactgtggaaaatgctattcaaattacaagtggcaagtgggaggccataaatatattcagagtaacacaggattcactgttttattctagcaatgaatttgaagaataccctggaagaagaaacatctacagaattagcattggaagctatcctccaagcaagaagtgtgttacttgccatctaaggaaagaaaggtgccaatattacacagcaagtttcagcgactacgccaagtactatgcacttgtctgctacggcccaggcatccccatttccacccttcatgatggacgcactgatcaagaaattaaaatcctggaagaaaacaaggaattggaaaatgctttgaaaaatatccagctgcctaaagaggaaattaagaaacttgaagtagatgaaattactttatggtacaagatgattcttcctcctcaatttgacagatcaaagaagtatcccttgctaattcaagtgtatggtggtccctgcagtcagagtgtaaggtctgtatttgctgttaattggatatcttatcttgcaagtaaggaagggatggtcattgccttggtggatggtcgaggaacagctttccaaggtgacaaactcctctatgcagtgtatcgaaagctgggtgtttatgaagttgaagaccagattacagctgtcagaaaattcatagaaatgggtttcattgatgaaaaaagaatagccatatggggctggtcctatggaggatacgtttcatcactggcccttgcatctggaactggtcttttcaaatgtggtatagcagtggctccagtctccagctgggaatattacgcgtctgtctacacagagagattcatgggtctcccaacaaaggatgataatcttgagcactataagaattcaactgtgatggcaagagcagaatatttcagaaatgtagactatcttctcatccacggaacagcagatgataatgtgcactttcaaaactcagcacagattgctaaagctctggttaatgcacaagtggatttccaggcaatgtggtactctgaccagaaccacggcttatccggcctgtccacgaaccacttatacacccacatgacccacttcctaaagcagtgtttctctttgtcagacggcaaaaagaaaaagaaaaagggccaccaccatcaccatcac

SEQ ID NO: 23 - protein, 761 aa, Mus musculus
MKTWLKTVFGVTTLAALALVVICIVLRPSRVYKPEGNTKRALTLKDILNGTFSYKTYFPNWISEQEYLHQSEDDNIVFYNIETRESYIILSNSTMKSVNATDYGLSPDRQFVYLESDYSKLWRYSYTATYYIYDLQNGEFVRGYELPRPIQYLCWSPVGSKLAYVYQNNIYLKQRPGDPPFQITYTGRENRIFNGIPDWVYEEEMLATKYALWWSPDGKFLAYVEFNDSDIPIIAYSYYGDGQYPRTINIPYPKAGAKNPVVRVFIVDTTYPHHVGPMEVPVPEMIASSDYYFSWLTWVSSERVCLQWLKRVQNVSVLSICDFREDWHAWECPKNQEHVEESRTGWAGGFFVSTPAFSQDATSYYKIFSDKDGYKHIHYIKDTVENAIQITSGKWEAIYIFRVTQDSLFYSSNEFEGYPGRRNIYRISIGNSPPSKKCVTCHLRKERCQYYTASFSYKAKYYALVCYGPGLPISTLHDGRTDQEIQVLEENKELENSLRNIQLPKVEIKKLKDGGLTFWYKMILPPQFDRSKKYPLLIQVYGGPCSQSVKSVFAVNWITYLASKEGIVIALVDGRGTAFQGDKFLHAVYRKLGVYEVEDQLTAVRKFIEMGFIDEERIAIWGWSYGGYVSSLALASGTGLFKCGIAVAPVSSWEYYASIYSERFMGLPTKDDNLEHYKNSTVMARAEYFRNVDYLLIHGTADDNVHFQNSAQIAKALVNAQVDFQAMWYSDQNHGISSGRSQNHLYTHMTHFLKQCFSLSD

SEQ ID NO: 24 - protein, 749 aa, Artificial sequence
  Murine FAP ectodomain+poly-lys-tag+his6-tag
RPSRVYKPEGNTKRALTLKDILNGTFSYKTYFPNWISEQEYLHQSEDDNIVFYNIETRESYIILSNSTMKSVNATDYGLSPDRQFVYLESDYSKLWRYSYTATYYIYDLQNGEFVRGYELPRPIQYLCWSPVGSKLAYVYQNNIYLKQRPGDPPFQITYTGRENRIFNGIPDWVYEEEMLATKYALWWSPDGKFLAYVEFNDSDIPIIAYSYYGDGQYPRTINIPYPKAGAKNPVVRVFIVDTTYPHHVGPMEVPVPEMIASSDYYFSWLTWVSSERVCLQWLKRVQNVSVLSICDFREDWHAWECPKNQEHVEESRTGWAGGFFVSTPAFSQDATSYYKIFSDKDGYKHIHYIKDTVENAIQITSGKWEAIYIFRVTQDSLFYSSNEFEGYPGRRNIYRISIGNSPPSKKCVTCHLRKERCQYYTASFSYKAKYYALVCYGPGLPISTLHDGRTDQEIQVLEENKELENSLRNIQLPKVEIKKLKDGGLTFWYKMILPPQFDRSKKYPLLIQVYGGPCSQSVKSVFAVNWITYLASKEGIVIALVDGRGTAFQGDKFLHAVYRKLGVYEVEDQLTAVRKFIEMGFIDEERIAIWGWSYGGYVSSLALASGTGLFKCGIAVAPVSSWEYYASIYSERFMGLPTKDDNLEHYKNSTVMARAEYFRNVDYLLIHGTADDNVHFQNSAQIAKALVNAQVDFQAMWYSDQNHGILSGRSQNHLYTHMTHFLKQCFSLSDGKKKKKKGHHHHHH

SEQ ID NO: 25 - DNA, 2247 bp, Artificial sequence
  Murine FAP ectodomain+poly-lys-tag+his6-tag
cgtccctcaagagtttacaaacctgaaggaaacacaaagagagctcttaccttgaaggatattttaaatggaacattctcatataaaacatattttcccaactggatttcagaacaagaatatcttcatcaatctgaggatgataacatagtattttataatattgaaacaagagaatcatatatcattttgagtaatagcaccatgaaaagtgtgaatgctacagattatggtttgtcacctgatcggcaatttgtgtatctagaaagtgattattcaaagctctggcgatattcatacacagcgacatactacatctacgaccttcagaatggggaatttgtaagaggatacgagctccctcgtccaattcagtatctatgctggtcgcctgttgggagtaaattagcatatgtatatcaaaacaatatttatttgaaacaaagaccaggagatccaccttttcaaataacttatactggaagagaaaatagaatatttaatggaataccagactgggtttatgaagaggaaatgcttgccacaaaatatgctctttggtggtctccagatggaaaatttttggcatatgtagaatttaatgattcagatataccaattattgcctattcttattatggtgatggacagtatcctagaactataaatattccatatccaaaggctggggctaagaatccggttgttcgtgtttttattgttgacaccacctaccctcaccacgtgggcccaatggaagtgccagttccagaaatgatagcctcaagtgactattatttcagctggctcacatgggtgtccagtgaacgagtatgcttgcagtggctaaaaagagtgcagaatgtctcagtcctgtctatatgtgatttcagggaagactggcatgcatgggaatgtccaaagaaccaggagcatgtagaagaaagcagaacaggatgggctggtggattctttgtttcgacaccagcttttagccaggatgccacttcttactacaaaatatttagcgacaaggatggttacaaacatattcactacatcaaagacactgtggaaaatgctattcaaattacaagtggcaagtgggaggccatatatatattccgcgtaacacaggattcactgttttattctagcaatgaatttgaaggttaccctggaagaagaaacatctacagaattagcattggaaactctcctccgagcaagaagtgtgttacttgccatctaaggaaagaaaggtgccaatattacacagcaagtttcagctacaaagccaagtactatgcactcgtctgctatggccctggcctccccatttccaccctccatgatggccgcacagaccaagaaatacaagtattagaagaaaacaaagaactggaaaattctctgagaaatatccagctgcctaaagtggagattaagaagctcaaagacgggggactgactttctggtacaagatgattctgcctcctcagtttgacagatcaaagaagtaccctttgctaattcaagtgtatggtggtccttgtagccagagtgttaagtctgtgtttgctgttaattggataacttatctcgcaagtaaggaggggatagtcattgccctggtagatggtcggggcactgctttccaaggtgacaaattcctgcatgccgtgtatcgaaaactgggtgtatatgaagttgaggaccagctcacagctgtcagaaaattcatagaaatgggtttcattgatgaagaaagaatagccatatggggctggtcctacggaggttatgtttcatccctggcccttgcatctggaactggtcttttcaaatgtggcatagcagtggctccagtctccagctgggaatattacgcatctatctactcagagagattcatgggcctcccaacaaaggacgacaatctcgaacactataaaaattcaactgtgatggcaagagcagaatatttcagaaatgtagactatcttctcatccacggaacagcagatgataatgtgcactttcagaactcagcacagattgctaaagctttggttaatgcacaagtggatttccaggcgatgtggtactctgaccagaaccatggtatattatctgggcgctcccagaatcatttatatacccacatgacgcacttcctcaagcaatgcttttctttatcagacggcaaaaagaaaaagaaaaagggccaccaccatcaccatcac

SEQ ID NO: 26 - protein, 748 aa, Artificial sequence
  Cynomolgus FAP ectodomain+poly-lys-tag+his6-tag
RPPRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPFVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEDYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSDGKKKKKKGHHHHHH

SEQ ID NO: 27 - DNA, 2244 bp, Artificial sequence
  Cynomolgus FAP ectodomain+poly-lys-tag+his6-tag
cgccctccaagagttcataactctgaagaaaatacaatgagagcactcacactgaaggatattttaaatgggacattttcttataaaacattttttccaaactggatttcaggacaagaatatcttcatcaatctgcagataacaatatagtactttataatattgaaacaggacaatcatataccattttgagtaacagaaccatgaaaagtgtgaatgcttcaaattatggcttatcacctgatcggcaatttgtatatctagaaagtgattattcaaagctttggagatactcttacacagcaacatattacatctatgaccttagcaatggagaatttgtaagaggaaatgagcttcctcgtccaattcagtatttatgctggtcgcctgttgggagtaaattagcatatgtctatcaaaacaatatctatttgaaacaaagaccaggagatccaccttttcaaataacatttaatggaagagaaaataaaatatttaatggaatcccagactgggtttatgaagaggaaatgcttgctacaaaatatgctctctggtggtctcctaatggaaaatttttggcatatgcggaatttaatgatacagatataccagttattgcctattcctattatggcgatgaacaatatcccagaacaataaatattccatacccaaaggccggagctaagaatccttttgttcggatatttattatcgataccacttaccctgcgtatgtaggtccccaggaagtgcctgttccagcaatgatagcctcaagtgattattatttcagttggctcacgtgggttactgatgaacgagtatgtttgcagtggctaaaaagagtccagaatgtttcggtcttgtctatatgtgatttcagggaagactggcagacatgggattgtccaaagacccaggagcatatagaagaaagcagaactggatgggctggtggattctttgtttcaacaccagttttcagctatgatgccatttcatactacaaaatatttagtgacaaggatggctacaaacatattcactatatcaaagacactgtggaaaatgctattcaaattacaagtggcaagtgggaggccataaatatattcagagtaacacaggattcactgttttattctagcaatgaatttgaagattaccctggaagaagaaacatctacagaattagcattggaagctatcctccaagcaagaagtgtgttacttgccatctaaggaaagaaaggtgccaatattacacagcaagtttcagcgactacgccaagtactatgcacttgtctgctatggcccaggcatccccatttccacccttcatgacggacgcactgatcaagaaattaaaatcctggaagaaaacaaggaattggaaaatgctttgaaaaatatccagctgcctaaagaggaaattaagaaacttgaagtagatgaaattactttatggtacaagatgattcttcctcctcaatttgacagatcaaagaagtatcccttgctaattcaagtgtatggtggtccctgcagtcagagtgtaaggtctgtatttgctgttaattggatatcttatcttgcaagtaaggaagggatggtcattgccttggtggatggtcggggaacagctttccaaggtgacaaactcctgtatgcagtgtatcgaaagctgggtgtttatgaagttgaagaccagattacagctgtcagaaaattcatagaaatgggtttcattgatgaaaaaagaatagccatatggggctggtcctatggaggatatgtttcatcactggcccttgcatctggaactggtcttttcaaatgtgggatagcagtggctccagtctccagctgggaatattacgcgtctgtctacacagagagattcatgggtctcccaacaaaggatgataatcttgagcactataagaattcaactgtgatggcaagagcagaatatttcagaaatgtagactatcttctcatccacggaacagcagatgataatgtgcactttcaaaactcagcacagattgctaaagctctggttaatgcacaagtggatttccaggcaatgtggtactctgaccagaaccacggcttatccggcctgtccacgaaccacttatacacccacatgacccacttcctaaagcagtgtttctctttgtcagacggcaaaaagaaaaagaaaaagggccaccaccatcaccatcac

SEQ ID NO: 28 - protein, 702 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNKLSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 29 - protein, 2322 aa, Homo sapiens
MQSGPRPPLPAPGLALALTLTMLARLASAASFFGENHLEVPVATALTDIDLQLQFSTSQPEALLLLAAGPADHLLLQLYSGRLQVRLVLGQEELRLQTPAETLLSDSIPHTVVLTVVEGWATLSVDGFLNASSAVPGAPLEVPYGLFVGGTGTLGLPYLRGTSRPLRGCLHAATLNGRSLLRPLTPDVHEGCAEEFSASDDVALGFSGPHSLAAFPAWGTQDEGTLEFTLTTQSRQAPLAFQAGGRRGDFIYVDIFEGHLRAVVEKGQGTVLLHNSVPVADGQPHEVSVHINAHRLEISVDQYPTHTSNRGVLSYLEPRGSLLLGGLDAEASRHLQEHRLGLTPEATNASLLGCMEDLSVNGQRRGLREALLTRNMAAGCRLEEEEYEDDAYGHYEAFSTLAPEAWPAMELPEPCVPEPGLPPVFANFTQLLTISPLVVAEGGTAWLEWRHVQPTLDLMEAELRKSQVLFSVTRGARHGELELDIPGAQARKMFTLLDVVNRKARFIHDGSEDTSDQLVLEVSVTARVPMPSCLRRGQTYLLPIQVNPVNDPPHIIFPHGSLMVILEHTQKPLGPEVFQAYDPDSACEGLTFQVLGTSSGLPVERRDQPGEPATEFSCRELEAGSLVYVHRGGPAQDLTFRVSDGLQASPPATLKVVAIRPAIQIHRSTGLRLAQGSAMPILPANLSVETNAVGQDVSVLFRVTGALQFGELQKQGAGGVEGAEWWATQAFHQRDVEQGRVRYLSTDPQHHAYDTVENLALEVQVGQEILSNLSFPVTIQRATVWMLRLEPLHTQNTQQETLTTAHLEATLEEAGPSPPTFHYEVVQAPRKGNLQLQGTRLSDGQGFTQDDIQAGRVTYGATARASEAVEDTFRFRVTAPPYFSPLYTFPIHIGGDPDAPVLTNVLLVVPEGGEGVLSADHLFVKSLNSASYLYEVMERPRHGRLAWRGTQDKTTMVTSFTNEDLLRGRLVYQHDDSETTEDDIPFVATRQGESSGDMAWEEVRGVFRVAIQPVNDHAPVQTISRIFHVARGGRRLLTTDDVAFSDADSGFADAQLVLTRKDLLFGSIVAVDEPTRPIYRFTQEDLRKRRVLFVHSGADRGWIQLQVSDGQHQATALLEVQASEPYLRVANGSSLVVPQGGQGTIDTAVLHLDTNLDIRSGDEVHYHVTAGPRWGQLVRAGQPATAFSQQDLLDGAVLYSHNGSLSPRDTMAFSVEAGPVHTDATLQVTIALEGPLAPLKLVRHKKIYVFQGEAAEIRRDQLEAAQEAVPPADIVFSVKSPPSAGYLVMVSRGALADEPPSLDPVQSFSQEAVDTGRVLYLHSRPEAWSDAFSLDVASGLGAPLEGVLVELEVLPAAIPLEAQNFSVPEGGSLTLAPPLLRVSGPYFPTLLGLSLQVLEPPQHGALQKEDGPQARTLSAFSWRMVEEQLIRYVHDGSETLTDSFVLMANASEMDRQSHPVAFTVTVLPVNDQPPILTTNTGLQMWEGATAPIPAEALRSTDGDSGSEDLVYTIEQPSNGRVVLRGAPGTEVRSFTQAQLDGGLVLFSHRGTLDGGFRFRLSDGEHTSPGHFFRVTAQKQVLLSLKGSQTLTVCPGSVQPLSSQTLRASSSAGTDPQLLLYRVVRGPQLGRLFHAQQDSTGEALVNFTQAEVYAGNILYEHEMPPEPFWEAHDTLELQLSSPPARDVAATLAVAVSFEAACPQRPSHLWKNKGLWVPEGQRARITVAALDASNLLASVPSPQRSEHDVLFQVTQFPSRGQLLVSEEPLHAGQPHFLQSQLAAGQLVYAHGGGGTQQDGFHFRAHLQGPAGASVAGPQTSEAFAITVRDVNERPPQPQASVPLRLTRGSRAPISRAQLSVVDPDSAPGEIEYEVQRAPHNGFLSLVGGGLGPVTRFTQADVDSGRLAFVANGSSVAGIFQLSMSDGASPPLPMSLAVDILPSAIEVQLRAPLEVPQALGRSSLSQQQLRVVSDREEPEAAYRLIQGPQYGHLLVGGRPTSAFSQFQIDQGEVVFAFTNFSSSHDHFRVLALARGVNASAVVNVTVRALLHVWAGGPWPQGATLRLDPTVLDAGELANRTGSVPRFRLLEGPRHGRVVRVPRARTEPGGSQLVEQFTQQDLEDGRLGLEVGRPEGRAPGPAGDSLTLELWAQGVPPAVASLDFATEPYNAARPYSVALLSVPEAARTEAGKPESSTPTGEPGPMASSPEPAVAKGGFLSFLEANMFSVIIPMCLVLLLLALILPLLFYLRKRNKTGKHDVQVLTAKPRNGLAGDTETFRKVEPGQAIPLTAVPGQGPPPGGQPDPELLQFCRTPNPALKNGQYWV

SEQ ID NO: 30 - protein, 1210 aa, Homo sapiens [sequence omitted]

SEQ ID NO: 31 - protein, 556 aa, Homo sapiens [sequence omitted]

SEQ ID NO: 32 - protein, 297 aa, Homo sapiens
MTTPRNSVNGTFPAEPMKGPIAMQSGPKPLFRRMSSLVGPTQSFFMRESKTLGAVQIMNGLFHIALGGLLMIPAGIYAPICVTVWYPLWGGIMYIISGSLLAATEKNSRKCLVKGKMIMNSLSLFAAISGMILSIMDILNIKISHFLKMESLNFIRAHTPYINIYNCEPANPSEKNSPSTQYCYSIQSLFLGILSVMLIFAFFQELVIAGIVENEWKRTCSRPKSNIVLLSAEEKKEQTIEIKEEVVGLTETSSQPKNEEDIEIIPIQEEEEEETETNFPEPPQDQESSPIENDSSP

SEQ ID NO: 33 - protein, 364 aa, Homo sapiens
MPLLLLLPLLWAGALAMDPNFWLQVQESVTVQEGLCVLVPCTFFHPIPYYDKNSPVHGYWFREGAIISRDSPVATNKLDQEVQEETQGRFRLLGDPSRNNCSLSIVDARRRDNGSYFFRMERGSTKYSYKSPQLSVHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGVVHGAIGGAGVTALLALCLCLIFFIVKTHRRKAARTAVGRNDTHPTTGSASPKHQKKSKLHGPTETSSCSGAAPTVEMDEELHYASLNFHGMNPSKDTSTEYSEVRTQ

SEQ ID NO: 34 - protein, 205 aa, Homo sapiens
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGAAFQLTQGDQLSTHTDGIPHLVLSPSTVFFGAFAL

SEQ ID NO: 35 - protein, 233 aa, Homo sapiens
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 36 - protein, 244 aa, Homo sapiens
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELLLEGAETVTPVLDPARRQGYGPLWYTSVGFGGLVQLRRGERVYVNISHPDMVDFARGKTFFGAVMVG

SEQ ID NO: 37 - protein, 183 aa, Homo sapiens
MERVQPLEENVGNAARPRFERNKLLLVASVIQGLGLLLCFTYICLHFSALQVSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 38 - protein, 261 aa, Homo sapiens
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 39 - protein, 281 aa, Homo sapiens
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVMMEGKMMSYCTTGQMWARSSYLGAVFNLTSADHLYVNVSELSLVNFEESQTFFGLYKL

SEQ ID NO: 40 - protein, 193 aa, Homo sapiens
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGCTIASQRLTPLARGDTLCTNLTGTLLPSRNTDETFFGVQWVRP

SEQ ID NO: 41 - protein, 234 aa, Homo sapiens
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQALVTVCESGMQTKHVYQNLSQFLLDYLQVNTTISVNVDTFQYIDTSTFPLENVLSIFLYSNSD

SEQ ID NO: 42 - protein, 254 aa, Homo sapiens
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 43 - protein, 281 aa, Homo sapiens [sequence omitted]

SEQ ID NO: 44 - protein, 317 aa, Homo sapiens
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKGGSTKYWSGNSEFHFYSINVGGFFKLRSGEEISIEVSNPSLLDPDQDATYFGAFKVRDID

SEQ ID NO: 45 - protein, 249 aa, Homo sapiens
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALRCLEEFSATAASSLGPQLRLCQVSGLLALRPGSSLRIRTLPWAHLKAAPFLTYFGLFQVH

SEQ ID NO: 46 - protein, 250 aa, Homo sapiens [sequence omitted]

SEQ ID NO: 47 - protein, 285 aa, Homo sapiens
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTLFRCIQNMPETLPNNSCYSAGIAKLEEGDELQLAIPRENAQISLDGDVTFFGALKLL

SEQ ID NO: 48 - protein, 240 aa, Homo sapiens
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELLVSQQSPCGRATSSSRVWWDSSFLGGVVHLEAGEKVVVRVLDERLVRLRDGTRSYFGAFMV

SEQ ID NO: 49 - protein, 251 aa, Homo sapiens
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGTKSVCEVGSNWFQPIYLGAMFSLQEGDKLMVNVSDISLVDYTKEDKTFFGAFLL

SEQ ID NO: 50 - protein, 199 aa, Homo sapiens
MTLHPSPITCEFLFSTALISPKMCLSHLENMPLSHSRTQGAQRSSWKLWLFCSIVMLLFLCSFSWLIFIFLQLETAKEPCMAKFGPLPSKWQMASSEPPCVNKVSDWKLEILQNGLYLIYGQVAPNANYNDVAPFEVRLYKNKDMIQTLTNKSKIQNVGGTYELHVGDTIDLIFNSEHQVLKNNTYWGIILLANPQFIS

SEQ ID NO: 51 - protein, 391 aa, Homo sapiens
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNDLSGGVLNDWSRITMNPKVFKLHPRSGELEVLVDGTYFIYSQVEVYYINFTDFASYEVVVDEKPFLQCTRSIETGKTNYNTCYTAGVCLLKARQKIAVKMVHADISINMSKHTTFFGAIRLGEAPAS

SEQ ID NO: 52 - protein, 205 aa, Homo sapiens
ACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 53 - protein, 133 aa, Homo sapiens
QVSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 54 - protein, 132 aa, Homo sapiens
VSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 55 - protein, 10 aa, Artificial Sequence
  Peptide linker (SG4)2
SGGGGSGGGG

SEQ ID NO: 56 - protein, 14 aa, Artificial Sequencs
  Peptide linker
GGGGSGGGGSGGGG

SEQ ID NO: 57 - protein, 10 aa, Artificial Sequence
  Peptide linker
GSPGSSSSGS

SEQ ID NO: 58 - protein, 20 aa, Artificial Sequence
  Peptide linker
GGGGSGGGGSGGGGSGGGGS

SEQ ID NO: 59 - protein, 8 aa, Artificial Sequence
  Peptide linker
GSGSGNGS

SEQ ID NO: 60 - protein, 8 aa, Artificial Sequence
  Peptide Linker
GGSGSGSG

SEQ ID NO: 61 - protein, 6 aa, Artificial Sequence
  Peptide linker
GGSGSG

SEQ ID NO: 62 - protein, 4 aa, Artificial Sequence
  Peptide linker
GGSG

SEQ ID NO: 63 - protein, 8 aa, Artificial Sequence
  Peptide linker
GGSGNGSG

SEQ ID NO: 64 - protein, 8 aa, Artificial Sequence
  Peptide Linker
GGNGSGSG

SEQ ID NO: 65 - protein, 6 aa, Artificial Sequence
  Peptide linker
GGNGSG

SEQ ID NO: 66 - DNA, 2154 bp, Artificial Sequence
  dimeric hu 4-1BBL (71-254) -CH1 FC knob chain
agagagggccctgagctgagccccgatgatcctgctggactgctggacctgcggcagggcatgtttgctcagctggtggcccagaacgtgctgctgatcgatggccccctgtcctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgaaggatctggctctgtgtctctggccctgcatctgcagcctctgagaagcgctgctggcgctgcagctctggcactgacagtggatctgcctcctgccagctccgaggcccggaatagcgcatttgggtttcaaggcaggctgctgcacctgtctgccggccagaggctgggagtgcatctgcacacagaggccagggctagacacgcctggcagctgacacagggcgctacagtgctgggcctgttcagagtgacccccgagattccagccggcctgccttctccaagaagcgaaggcggaggcggatctggcggcggaggatctagagagggacccgaactgtcccctgacgatccagccgggctgctggatctgagacagggaatgttcgcccagctggtggctcagaatgtgctgctgattgacggacctctgagctggtactccgacccagggctggcaggggtgtccctgactgggggactgtcctacaaagaagatacaaaagaactggtggtggctaaagctggggtgtactatgtgttttttcagctggaactgaggcgggtggtggctggggagggctcaggatctgtgtccctggctctgcatctgcagccactgcgctctgctgctggcgcagctgcactggctctgactgtggacctgccaccagcctctagcgaggccagaaacagcgccttcgggttccaaggacgcctgctgcatctgagcgccggacagcgcctgggagtgcatctgcatactgaagccagagcccggcatgcttggcagctgactcagggggcaactgtgctgggactgtttcgcgtgacacctgagatccctgccggactgccaagccctagatcagaagggggcggaggaagcggagggggaggaagtgctagcaccaagggccctagcgtgttccctctggcccctagcagcaagagcacaagtggaggaacagccgccctgggctgcctggtcaaggactacttccccgagcccgtgaccgtgtcctggaattctggcgccctgacaagcggcgtgcacacatttccagccgtgctgcagagcagcggcctgtactctctgagcagcgtcgtgaccgtgccctctagctctctgggcacccagacctacatctgcaacgtgaaccacaagcccagcaacaccaaagtggacaagaaggtggaacccaagagctgcgacaagacccacacctgtcccccttgccctgcccctgaagctgctggtggcccttccgtgttcctgttccccccaaagcccaaggacaccctgatgatcagccggacccccgaagtgacctgcgtggtggtcgatgtgtcccacgaggaccctgaagtgaagttcaattggtacgtggacggcgtggaagtgcacaatgccaagaccaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 67 - DNA, 903 bp, Artificial Sequence
  monomeric hu 4-1BBL(71-254) -CL
agagagggccctgagctgagccccgatgatcctgctggactgctggacctgcggcagggcatgtttgctcagctggtggcccagaacgtgctgctgatcgatggccccctgtcctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgaaggatctggctctgtgtctctggccctgcatctgcagcctctgagaagcgctgctggcgctgcagctctggcactgacagtggatctgcctcctgccagctccgaggcccggaatagcgcatttgggtttcaaggcaggctgctgcacctgtctgccggccagaggctgggagtgcatctgcacacagaggccagggctagacacgcctggcagctgacacagggcgctacagtgctgggcctgttcagagtgacccccgagattccagccggcctgccttctccaagaagcgaaggcggaggcggatctggcggcggaggatctcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 68 - DNA, 1338 bp, Artificial Sequence
  FAP(28H1) Fc hole heavy chain
gaagtgcagctgctggaatccggcggaggcctggtgcagcctggcggatctctgagactgtcctgcgccgcctccggcttcaccttctcctcccacgccatgtcctgggtccgacaggctcctggcaaaggcctggaatgggtgtccgccatctgggcctccggcgagcagtactacgccgactctgtgaagggccggttcaccatctcccgggacaactccaagaacaccctgtacctgcagatgaactccctgcgggccgaggacaccgccgtgtactactgtgccaagggctggctgggcaacttcgactactggggacagggcaccctggtcaccgtgtccagcgctagcaccaagggcccctccgtgttccccctggcccccagcagcaagagcaccagcggcggcacagccgctctgggctgcctggtcaaggactacttccccgagcccgtgaccgtgtcctggaacagcggagccctgacctccggcgtgcacaccttccccgccgtgctgcagagttctggcctgtatagcctgagcagcgtggtcaccgtgccttctagcagcctgggcacccagacctacatctgcaacgtgaaccacaagcccagcaacaccaaggtggacaagaaggtggagcccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 69 - DNA, 645 bp, Artificial Sequence
  FAP(28H1) light chain
gagatcgtgctgacccagtcccccggcaccctgtctctgagccctggcgagagagccaccctgtcctgcagagcctcccagtccgtgtcccggtcctacctcgcctggtatcagcagaagcccggccaggcccctcggctgctgatcatcggcgcctctaccagagccaccggcatccctgaccggttctccggctctggctccggcaccgacttcaccctgaccatctcccggctggaacccgaggacttcgccgtgtactactgccagcagggccaggtcatccctcccacctttggccagggcaccaaggtggaaatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 70 - protein, 309 aa, Mus musculus
MDQHTLDVEDTADARHPAGTSCPSDAALLRDTGLLADAALLSDTVRPTNAALPTDAAYPAVNVRDREAAWPPALNFCSRHPKLYGLVALVLLLLIAACVPIFTRTEPRPALTITTSPNLGTRENNADQVTPVSHIGCPNTTQQGSPVFAKLLAKNQASLCNTTLNWHSQDGAGSSYLSQGLRYEEDKKELVVDSPGLYYVFLELKLSPTFTNTGHKVQGWVSLVLQAKPQVDDFDNLALTVELFPCSMENKLVDRSWSQLLLLKAGHRLSVGLRAYLHGAQDAYRDWELSYPNTTSFGLFLVKPDNPWE

SEQ ID NO: 71 - DNA, 2298 bp, Artificial sequence
  dimeric 4-1BBL(71-254) -CH1-Fc knob chain
agaaccgagcccagacccgccctgaccatcaccaccagccctaacctgggcaccagagagaacaacgccgaccaagtgacccccgtgtcccacatcggcagccccaataccacacagcagggcagccctgtgttcgccaagctgctggccaagaaccaggccagcctgagcaacaccaccctgaactggcacagccaggatggcgccggaagcagctatctgagccagggcctgagatacgaagaggacaagaaagaactggtggtggacagccctggcctgtactacgtgttcctggaactgaagctgagccccaccttcaccaacaccggccacaaggtgcagggctgggtgtcactggtgctgcaggccaaaccccaggtggacgacttcgacaacctggccctgaccgtggaactgttccccagcagcatggaaaacaagctggtggatcggagctggtcccagcttctgctgctgaaggccggacacagactgagcgtgggcctgagggcttatctgcacggcgcccaggacgcctacagagactgggagctgagctaccccaacacaaccagcttcggcctgttcctcgtgaagcccgacaacccttgggaaggcggcggaggatctggcggaggcggatctagaacagagcctcggcctgccctgacaattaccacatcccccaatctgggcacccgggaaaacaatgcagatcaagtgacacctgtgtctcatattggctccccaaacactacccagcagggctcccccgtgtttgctaaactgctggctaaaaatcaggcctccctgtctaacacaacactgaactggcactcccaggacggcgctggcagctcttacctgagtcagggactgcgctatgaggaagataagaaagaactggtggtggattcccccggactgtactatgtgtttctggaactgaaactgtcccctacctttacaaataccgggcacaaagtgcagggatgggtgtccctggtgctgcaggctaagcctcaggtggacgattttgataatctggctctgacagtggaactgtttcctagcagcatggaaaacaagctggtggacagaagctggtcccagctcctgctgctgaaggccggacacagactgagcgtgggcctgagagcctatctgcacggcgcccaggacgcctacagagactgggagctgagctaccccaacacaaccagcttcggcctgttcctcgtgaagcccgacaacccttgggaaggcggcggaggatctggcggaggcggatccagagctgatgctgcccctaccgtgtccatcttcccacccagcagcgagcagctgacatctgggggagctagcgtcgtgtgcttcctgaacaacttctaccccaaggacatcaacgtgaagtggaagatcgacggcagcgagcggcagaacggcgtgctgaatagctggaccgaccaggacagcaaggactccacctacagcatgagcagcaccctgaccctgaccaaggacgagtacgagcggcacaacagctacacatgcgaggccacccacaagaccagcaccagccccatcgtgaagtccttcaaccggaacgagtgcgtgcccagagactgcggctgcaagccttgcatctgcaccgtgcctgaggtgtccagcgtgttcatcttcccacccaagcccaaggacgtgctgaccatcaccctgacacccaaagtgacctgcgtggtggtggccatcagcaaggatgaccccgaggtgcagttcagttggttcgtggacgacgtggaagtgcacaccgctcagaccaagcccagagaggaacagatcaacagcaccttcagaagcgtgtccgagctgcccatcatgcaccaggactggctgaacggcaaagaattcaagtgcagagtgaacagcgccgcctttggcgcccctatcgagaaaaccatctccaagaccaagggcagacccaaggccccccaggtgtacacaatccccccacccaaagaacagatggccaaggacaaggtgtccctgacctgcatgatcaccaatttcttcccagaggatatcaccgtggaatggcagtggaacggccagcccgccgagaactacgacaacacccagcctatcatggacaccgacggctcctacttcgtgtacagcgacctgaacgtgcagaagtccaactgggaggccggcaacaccttcacctgtagcgtgctgcacgagggcctgcacaaccaccacaccgagaagtccctgtcccacagccctggcaag

SEQ ID NO: 72 - DNA, 954 bp, Artificial Sequence
  Monomeric mu 4-1BBL(71-254) -CL fusion
agaaccgagcccagacccgccctgaccatcaccaccagccctaacctgggcaccagagagaacaacgccgaccaagtgacccccgtgtcccacatcggcagccccaataccacacagcagggcagccctgtgttcgccaagctgctggccaagaaccaggccagcctgagcaacaccaccctgaactggcacagccaggatggcgccggaagcagctatctgagccagggcctgagatacgaagaggacaagaaagaactggtggtggacagccctggcctgtactacgtgttcctggaactgaagctgagccccaccttcaccaacaccggccacaaggtgcagggctgggtgtcactggtgctgcaggccaaaccccaggtggacgacttcgacaacctggccctgaccgtggaactgttccccagcagcatggaaaacaagctggtggatcggagctggtcccagcttctgctgctgaaggccggacacagactgagcgtgggcctgagggcctatctgcatggcgcccaggacgcctacagagactgggagctgagctaccccaacacaaccagcttcggcctgttcctcgtgaagcccgacaacccttgggaaggcggcggaggctccggaggaggcggaagcgctaagaccaccccccccagcgtgtaccctctggcccctggatctgccgcccagaccaacagcatggtgaccctgggctgcctggtgaagggctacttccccgagcctgtgaccgtgacctggaacagcggcagcctgagcagcggcgtgcacacctttccagccgtgctgcagagcgacctgtacaccctgagcagctccgtgaccgtgcctagcagcacctggcccagccagacagtgacctgcaacgtggcccaccctgccagcagcaccaaggtggacaagaaaatcgtgccccgggactgc

SEQ ID NO: 73 - DNA, 1320 bp, Artificial sequence
  FAP Fc KK heavy chain
gaagtgcagctgctggaatccggcggaggcctggtgcagcctggcggatctctgagactgtcctgcgccgcctccggcttcaccttctcctcccacgccatgtcctgggtccgacaggctcctggcaaaggcctggaatgggtgtccgccatctgggcctccggcgagcagtactacgccgactctgtgaagggccggttcaccatctcccgggacaactccaagaacaccctgtacctgcagatgaactccctgcgggccgaggacaccgccgtgtactactgtgccaagggctggctgggcaacttcgactactggggacagggcaccctggtcaccgtgtccagcgctaagaccaccccccctagcgtgtaccctctggcccctggatctgccgcccagaccaacagcatggtgaccctgggctgcctggtgaagggctacttccccgagcctgtgaccgtgacctggaacagcggcagcctgagcagcggcgtgcacacctttccagccgtgctgcagagcgacctgtacaccctgagcagctccgtgaccgtgcctagcagcacctggcccagccagacagtgacctgcaacgtggcccaccctgccagcagcaccaaggtggacaagaaaatcgtgccccgggactgcggctgcaagccctgcatctgcaccgtgcccgaggtgtccagcgtgttcatcttcccacccaagcccaaggacgtgctgaccatcaccctgacccccaaagtgacctgcgtggtggtggccatcagcaaggacgaccccgaggtgcagttctcttggtttgtggacgacgtggaggtgcacacagcccagacaaagccccgggaggaacagatcaacagcaccttcagaagcgtgtccgagctgcccatcatgcaccaggactggctgaacggcaaagaattcaagtgcagagtgaacagcgccgccttcggcgcccccatcgagaaaaccatcagcaagaccaagggcagacccaaggccccccaggtgtacaccatccccccacccaaaaaacagatggccaaggacaaggtgtccctgacctgcatgatcaccaactttttccccgaggacatcaccgtggagtggcagtggaatggccagcccgccgagaactacaagaacacccagcccatcatgaagaccgacggcagctacttcgtgtacagcaagctgaacgtgcagaagtccaactgggaggccggcaacaccttcacctgtagcgtgctgcacgagggcctgcacaaccaccacaccgagaagtccctgagccactcccccggcaag

SEQ ID NO: 74 - DNA, 645 bp, Artificial sequence
  FAP light chain
gagatcgtgctgacccagtcccccggcaccctgtctctgagccctggcgagagagccaccctgtcctgcagagcctcccagtccgtgtcccggtcctacctcgcctggtatcagcagaagcccggccaggcccctcggctgctgatcatcggcgcctctaccagagccaccggcatccctgaccggttctccggctctggctccggcaccgacttcaccctgaccatctcccggctggaacccgaggacttcgccgtgtactactgccagcagggccaggtcatccctcccacctttggccagggcaccaaggtggaaatcaagcgtgccgatgctgcaccaactgtatcgattttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 75 - protein, 766 aa, Artificial sequence
  dimeric mu 4-1BBL(71-254)-CH1-Fc DD heavy chain
RTEPRPALTITTSPNLGTRENNADQVTPVSHIGSPNTTQQGSPVFAKLLAKNQASLSNTTLNWHSQDGAGSSYLSQGLRYEEDKKELVVDSPGLYYVFLELKLSPTFTNTGHKVQGWVSLVLQAKPQVDDFDNLALTVELFPSSMENKLVDRSWSQLLLLKAGHRLSVGLRAYLHGAQDAYRDWELSYPNTTSFGLFLVKPDNPWEGGGGSGGGGSRTEPRPALTITTSPNLGTRENNADQVTPVSHIGSPNTTQQGSPVFAKLLAKNQASLSNTTLNWHSQDGAGSSYLSQGLRYEEDKKELVVDSPGLYYVFLELKLSPTFTNTGHKVQGWVSLVLQAKPQVDDFDNLALTVELFPSSMENKLVDRSWSQLLLLKAGHRLSVGLRAYLHGAQDAYRDWELSYPNTTSFGLFLVKPDNPWEGGGGSGGGGSRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNECVPRDCGCKPCICTVPEVSSVFIFPPKPKDVLTITLTPKVTCVVVAISKDDPEVQFSWFVDDVEVHTAQTKPREEQINSTFRSVSELPIMHQDWLNGKEFKCRVNSAAFGAPIEKTISKTKGRPKAPQVYTIPPPKEQMAKDKVSLTCMITNFFPEDITVEWQWNGQPAENYDNTQPIMDTDGSYFVYSDLNVQKSNWEAGNTFTCSVLHEGLHNHHTEKSLSHSPGK

SEQ ID NO: 76 - protein, 318 aa, Artificial Sequence
  Monomeric mu 4-1BBL(71-254) -CL fusion
RTEPRPALTITTSPNLGTRENNADQVTPVSHIGSPNTTQQGSPVFAKLLAKNQASLSNTTLNWHSQDGAGSSYLSQGLRYEEDKKELVVDSPGLYYVFLELKLSPTFTNTGHKVQGWVSLVLQAKPQVDDFDNLALTVELFPSSMENKLVDRSWSQLLLLKAGHRLSVGLRAYLHGAQDAYRDWELSYPNTTSFGLFLVKPDNPWEGGGGSGGGGSAKTTPPSVYPLAPGSAAQTNSMVTLGCLVKGYFPEPVTVTWNSGSLSSGVHTFPAVLQSDLYTLSSSVTVPSSTWPSQTVTCNVAHPASSTKVDKKIVPRDC

SEQ ID NO: 77 - protein, 440 aa, Artificial sequence
  anti-FAP Fc KK heavy chain
EVQLLESGGGLVQPGGSLRLSCAASGFTFSSHAMSWVRQAPGKGLEWVSAIWASGEQYYADSVKGRFTISRDNSKNTLYLQMNSLRAEDTAVYYCAKGWLGNFDYWGQGTLVTVSSAKTTPPSVYPLAPGSAAQTNSMVTLGCLVKGYFPEPVTVTWNSGSLSSGVHTFPAVLQSDLYTLSSSVTVPSSTWPSQTVTCNVAHPASSTKVDKKIVPRDCGCKPCICTVPEVSSVFIFPPKPKDVLTITLTPKVTCVVVAISKDDPEVQFSWFVDDVEVHTAQTKPREEQINSTFRSVSELPIMHQDWLNGKEFKCRVNSAAFGAPIEKTISKTKGRPKAPQVYTIPPPKKQMAKDKVSLTCMITNFFPEDITVEWQWNGQPAENYKNTQPIMKTDGSYFVYSKLNVQKSNWEAGNTFTCSVLHEGLHNHHTEKSLSHSPGK

SEQ ID NO: 78 - protein, 215 aa, Artificial Sequence
  anti-FAP light chain
EIVLTQSPGTLSLSPGERATLSCRASQSVSRSYLAWYQQKPGQAPRLLIIGASTRATGIPDRFSGSGSGTDFTLTISRLEPEDFAVYYCQQGQVIPPTFGQGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 79 - DNA, 1335 bp, Artificial Sequence
  DP47 Fc hole heavy chain
gaggtgcaattgttggagtctgggggaggcttggtacagcctggggggtccctgagactctcctgtgcagcctccggattcacctttagcagttatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcagatgaacagcctgagagccgaggacacggccgtatattactgtgcgaaaggcagcggatttgactactggggccaaggaaccctggtcaccgtctcgagtgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 80 - DNA, 645 bp, Artificial Sequence
  DP47 light chain
gaaatcgtgttaacgcagtctccaggcaccctgtctttgtctccaggggaaagagccaccctctcttgcagggccagtcagagtgttagcagcagctacttagcctggtaccagcagaaacctggccaggctcccaggctcctcatctatggagcatccagcagggccactggcatcccagacaggttcagtggcagtggatccgggacagacttcactctcaccatcagcagactggagcctgaagattttgcagtgtattactgtcagcagtatggtagctcaccgctgacgttcggccaggggaccaaagtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 81 - protein, 445 aa, Artificial Sequence
  DP47 Fc hole heavy chain
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGSGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 82 - protein, 215 aa, Artificial sequence
  DP47 light chain
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 83 - protein, 163 aa, Homo sapiens
LQDPCSNCPAGTFCDNNRNQICSPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQ

SEQ ID NO: 84 - protein, 163 aa, Cynomolgus
LQDLCSNCPAGTFCDNNRSQICSPCPPNSFSSAGGQRTCDICRQCKGVFKTRKECSSTSNAECDCISGYHCLGAECSMCEQDCKQGQELTKKGCKDCCFGTFNDQKRGICRPWTNCSLDGKSVLVNGTKERDVVCGPSPADLSPGASSATPPAPAREPGHSPQ

SEQ ID NO: 85 - protein, 164 aa, Mus musculus
VQNSCDNCQPGTFCRKYNPVCKSCPPSTFSSIGGQPNCNICRVCAGYFRFKKFCSSTHNAECECIEGFHCLGPQCTRCEKDCRPGQELTKQGCKTCSLGTFNDQNGTGVCRPWTNCSLDGRSVLKTGTTEKDVVCGPPVVSFSPSTTISVTPEGGPGGHSLQVL

SEQ ID NO: 86 - DNA, 681 bp, Artificial Sequence
  Fc hole chain
gacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 87 - DNA, 1266 bp, Artificial sequence
  hu 4-1BB Fc knob fusion
ctgcaggacccctgcagcaactgccctgccggcaccttctgcgacaacaaccggaaccagatctgcagcccctgcccccccaacagcttcagctctgccggcggacagcggacctgcgacatctgcagacagtgcaagggcgtgttcagaacccggaaagagtgcagcagcaccagcaacgccgagtgcgactgcacccccggcttccattgtctgggagccggctgcagcatgtgcgagcaggactgcaagcagggccaggaactgaccaagaagggctgcaaggactgctgcttcggcaccttcaacgaccagaagcggggcatctgccggccctggaccaactgtagcctggacggcaagagcgtgctggtcaacggcaccaaagaacgggacgtcgtgtgcggccccagccctgctgatctgtctcctggggccagcagcgtgacccctcctgcccctgccagagagcctggccactctcctcaggtcgacgaacagttatattttcagggcggctcacccaaatctgcagacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggcctgaacgacatcttcgaggcccagaagattgaatggcacgag

SEQ ID NO: 88 - DNA, 1266 bp, Artificial Sequence
  Cynomolgus 4-1BB Fc knob fusion
ttgcaggatctgtgtagtaactgcccagctggtacattctgtgataataacaggagtcagatttgcagtccctgtcctccaaatagtttctccagcgcaggtggacaaaggacctgtgacatatgcaggcagtgtaaaggtgttttcaagaccaggaaggagtgttcctccaccagcaatgcagagtgtgactgcatttcagggtatcactgcctgggggcagagtgcagcatgtgtgaacaggattgtaaacaaggtcaagaattgacaaaaaaaggttgtaaagactgttgctttgggacatttaatgaccagaaacgtggcatctgtcgcccctggacaaactgttctttggatggaaagtctgtgcttgtgaatgggacgaaggagagggacgtggtctgcggaccatctccagccgacctctctccaggagcatcctctgcgaccccgcctgcccctgcgagagagccaggacactctccgcaggtcgacgaacagttatattttcagggcggctcacccaaatctgcagacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggcctgaacgacatcttcgaggcccagaagattgaatggcacgag

SEQ ID NO: 89 - DNA, 1269 bp, Artificial Sequence
  murine 4-1BB Fc knob fusion
gtgcagaacagctgcgacaactgccagcccggcaccttctgccggaagtacaaccccgtgtgcaagagctgcccccccagcaccttcagcagcatcggcggccagcccaactgcaacatctgcagagtgtgcgccggctacttccggttcaagaagttctgcagcagcacccacaacgccgagtgcgagtgcatcgagggcttccactgcctgggcccccagtgcaccagatgcgagaaggactgcagacccggccaggaactgaccaagcagggctgtaagacctgcagcctgggcaccttcaacgaccagaacgggaccggcgtgtgccggccttggaccaattgcagcctggacgggagaagcgtgctgaaaaccggcaccaccgagaaggacgtcgtgtgcggccctcccgtggtgtccttcagccctagcaccaccatcagcgtgacccctgaaggcggccctggcggacactctctgcaggtcctggtcgacgaacagttatattttcagggcggctcacccaaatctgcagacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggcctgaacgacatcttcgaggcccagaagattgaatggcacgag

SEQ ID NO: 90 - protein, 227 aa, Artificial sequence
  Fc hole chain
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 91 - protein, 422 aa, Artificial sequence
  human 4-1BB Fc knob fusion
LQDPCSNCPAGTFCDNNRNQICSPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQVDEQLYFQGGSPKSADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGKSGGLNDIFEAQKIEWHE

SEQ ID NO: 92 - protein, 422 aa, Artificial sequence
  cynomolgus 4-1BB Fc knob fusion
LQDLCSNCPAGTFCDNNRSQICSPCPPNSFSSAGGQRTCDICRQCKGVFKTRKECSSTSNAECDCISGYHCLGAECSMCEQDCKQGQELTKKGCKDCCFGTFNDQKRGICRPWTNCSLDGKSVLVNGTKERDVVCGPSPADLSPGASSATPPAPAREPGHSPQVDEQLYFQGGSPKSADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGKSGGLNDIFEAQKIEWHE

SEQ ID NO: 93 - protein, 423 aa, Artificial Sequence
  murine 4-1BB Fc knob fusion
VQNSCDNCQPGTFCRKYNPVCKSCPPSTFSSIGGQPNCNICRVCAGYFRFKKFCSSTHNAECECIEGFHCLGPQCTRCEKDCRPGQELTKQGCKTCSLGTFNDQNGTGVCRPWTNCSLDGRSVLKTGTTEKDVVCGPPVVSFSPSTTISVTPEGGPGGHSLQVLVDEQLYFQGGSPKSADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGKSGGLNDIFEAQKIEWHE

SEQ ID NO: 94 - DNA, 594 bp, Artificial sequence
  human 4-1BB His-tagged
ctgcaggacccctgcagcaactgccctgccggcaccttctgcgacaacaaccggaaccagatctgcagcccctgcccccccaacagcttcagctctgccggcggacagcggacctgcgacatctgcagacagtgcaagggcgtgttcagaacccggaaagagtgcagcagcaccagcaacgccgagtgcgactgcacccccggcttccattgtctgggagccggctgcagcatgtgcgagcaggactgcaagcagggccaggaactgaccaagaagggctgcaaggactgctgcttcggcaccttcaacgaccagaagcggggcatctgccggccctggaccaactgtagcctggacggcaagagcgtgctggtcaacggcaccaaagaacgggacgtcgtgtgcggccccagccctgctgatctgtctcctggggccagcagcgtgacccctcctgcccctgccagagagcctggccactctcctcaggtcgacgaacagttatattttcagggcggctcaggcctgaacgacatcttcgaggcccagaagatcgagtggcacgaggctcgagctcaccaccatcaccatcac

SEQ ID NO: 95 - protein, 198 aa, Artificial Sequence
  Human 4-1BB His-tagged
LQDPCSNCPAGTFCDNNRNQICSPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQVDEQLYFQGGSGLNDIFEAQKIEWHEARAHHHHHH

SEQ ID NO: 96 - protein, 178 aa, Homo sapiens
REGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGL

SEQ ID NO: 97 - protein, 366 aa, Artificial Sequence
  dimeric hu 4-1BBL connected by (G4S)2
REGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGL

SEQ ID NO: 98 - protein, 360 aa, Artificial Sequence
  dimeric hu 4-1BBL (80-254) connected by (G4S)2 linker
DPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 99 - protein, 416 aa, Artificial Sequence
  dimeric hu 4-1BBL (52-254) connected by (G4S)2 linker
PWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 100 - protein, 5 aa, Artificial Sequence
  FAP(4B9) CDR-H1
SYAMS

SEQ ID NO: 101 - protein, 17 aa, Artificial Sequence
  FAP(4B9) CDR-H2
AIIGSGASTYYADSVKG

SEQ ID NO: 102 - protein, 8 aa, Artificial Sequence
  FAP(4B9) CDR-H3
GWFGGFNY

SEQ ID NO: 103 - protein, 12 aa, Artificial Sequence
  FAP(4B9) CDR-L1
RASQSVTSSYLA

SEQ ID NO: 104 - protein, 7 aa, Artificial Sequence
  FAP(4B9) CDR-L2
VGSRRAT

SEQ ID NO: 105 - protein, 9 aa, Artificial Sequence
  FAP(4B9) CDR-L3
QQGIMLPPT

SEQ ID NO: 106 - protein, 117 aa, Artificial Sequence
  FAP(4B9) VH
EVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSS

SEQ ID NO: 107 - protein, 108 aa, Artificial Sequence
  FAP(4B9) VL
EIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIK

SEQ ID NO: 108 - protein, 718 aa, Artificial Sequence
  Dimeric hu 4-1BBL (71-254) - CH1* Fc knob chain
REGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 109 - protein, 301 aa, Artificial Sequence
  Monomeric hu 4-1BBL (71-254) -CL*
REGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 110 - protein, 296 aa, Artificial Sequence
  Monomeric hu 4-1BBL (71-254) -(G4S)1- CL*
REGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 111 - protein, 756 aa, Artificial Sequence
  Dimeric hu 4-1BBL (52-254) - CH1* Fc knob chain
PWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 112 - protein, 320 aa, Artificial Sequence
  Monomeric hu 4-1BBL (52-254) -CL*
PWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 113 - protein, 700 aa, Artificial Sequence
  Dimeric hu 4-1BBL (80-254) - CH1* Fc knob chain
DPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 114 - protein, 292 aa, Artificial Sequence
  Monomeric hu 4-1BBL (80-254) -CL*
DPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 115 - protein, 722 aa, Artificial Sequence
  Dimeric hu 4-1BBL (71-254) - CL* Fc knob chain
REGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGECDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 116 - protein, 297 aa, Artificial Sequence
  Monomeric hu 4-1BBL (71-254) -CH1*
REGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSC

SEQ ID NO: 117 - protein, 722 aa, Artificial Sequence
  Dimeric hu 4-1BBL (71-254) - CL Fc knob chain
REGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 118 - protein, 297 aa, Artificial Sequence
  Monomeric hu 4-1BBL (71-254) - CH1
REGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 119 - protein, 710 aa, Artificial Sequence
  Dimeric hu 4-1BBL (71-248) - CL* Fc knob chain
REGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLGGGGSGGGGSRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGECDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 120 - protein, 291 aa, Artificial Sequence
  Monomeric hu 4-1BBL (71-248) - CH1*
REGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLGGGGSGGGGSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSC

SEQ ID NO: 121 - protein, 833 aa, Artificial Sequence
  anti-FAP (28H1) Fc hole chain fused to dimeric hu 4-1BBL (71-254)
EVQLLESGGGLVQPGGSLRLSCAASGFTFSSHAMSWVRQAPGKGLEWVSAIWASGEQYYADSVKGRFTISRDNSKNTLYLQMNSLRAEDTAVYYCAKGWLGNFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 122 - protein, 639 aa, Artificial Sequence
  anti-FAP (28H1) Fc knob chain fused to monomeric hu 4-1BBL (71-254)
EVQLLESGGGLVQPGGSLRLSCAASGFTFSSHAMSWVRQAPGKGLEWVSAIWASGEQYYADSVKGRFTISRDNSKNTLYLQMNSLRAEDTAVYYCAKGWLGNFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 123 - protein, 834 aa, Artificial Sequence
  anti-FAP (4B9) Fc hole chain fused to dimeric hu 4-1BBL (71-254)
EVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 124 - protein, 640 aa, Artificial Sequence
  anti-FAP (4B9) Fc knob chain fused to monomeric hu 4-1BBL (71-254)
EVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 125 - protein, 215 aa, Artificial Sequence
  anti-FAP (4B9) light chain
EIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 126 - protein, 822 aa, Artificial Sequence
  anti-FAP (4B9) Fc hole chain fused to dimeric hu 4-1BBL (71-248)
EVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGL

SEQ ID NO: 127 - protein, 634 aa, Artificial Sequence
  anti-FAP (4B9) Fc knob chain fused to monomeric hu 4-1BBL (71-248)
EVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGL

SEQ ID NO: 128 - protein, 5 aa, Artificial Sequence
  Peptide linker G4S
GGGGS

SEQ ID NO: 129 - DNA, 2166 bp, Artificial Sequence
  Dimeric hu 4-1BBL (71-254) - CL* Fc knob chain
agagagggccctgagctgagccccgatgatcctgctggactgctggacctgcggcagggcatgtttgctcagctggtggcccagaacgtgctgctgatcgatggccccctgtcctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgaaggatctggctctgtgtctctggccctgcatctgcagcctctgagaagcgctgctggcgctgcagctctggcactgacagtggatctgcctcctgccagctccgaggcccggaatagcgcatttgggtttcaaggcaggctgctgcacctgtctgccggccagaggctgggagtgcatctgcacacagaggccagggctagacacgcctggcagctgacacagggcgctacagtgctgggcctgttcagagtgacccccgagattccagccggcctgccttctccaagaagcgaaggcggaggcggatctggcggcggaggatctagagagggacccgaactgtcccctgacgatccagccgggctgctggatctgagacagggaatgttcgcccagctggtggctcagaatgtgctgctgattgacggacctctgagctggtactccgacccagggctggcaggggtgtccctgactgggggactgtcctacaaagaagatacaaaagaactggtggtggctaaagctggggtgtactatgtgttttttcagctggaactgaggcgggtggtggctggggagggctcaggatctgtgtccctggctctgcatctgcagccactgcgctctgctgctggcgcagctgcactggctctgactgtggacctgccaccagcctctagcgaggccagaaacagcgccttcgggttccaaggacgcctgctgcatctgagcgccggacagcgcctgggagtgcatctgcatactgaagccagagcccggcatgcttggcagctgactcagggggcaactgtgctgggactgtttcgcgtgacacctgagatccctgccggactgccaagccctagatcagaagggggcggaggttccggagggggaggatctcgtacggtggctgcaccatctgtctttatcttcccacccagcgaccggaagctgaagtctggcacagccagcgtcgtgtgcctgctgaataacttctacccccgcgaggccaaggtgcagtggaaggtggacaatgccctgcagagcggcaacagccaggaaagcgtgaccgagcaggacagcaaggactccacctacagcctgagcagcaccctgaccctgagcaaggccgactacgagaagcacaaggtgtacgcctgcgaagtgacccaccagggcctgtctagccccgtgaccaagagcttcaaccggggcgagtgcgacaagacccacacctgtcctccatgccctgcccctgaagctgctggcggccctagcgtgttcctgttccccccaaagcccaaggacaccctgatgatcagccggacccctgaagtgacctgcgtggtggtggatgtgtcccacgaggaccctgaagtgaagttcaattggtacgtggacggcgtggaagtgcacaatgccaagaccaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 130 - DNA, 891 bp, Artificial Sequence
  Monomeric hu 4-1BBL (71-254) -CH1*
agagagggccctgagctgagccccgatgatcctgctggactgctggacctgcggcagggcatgtttgctcagctggtggcccagaacgtgctgctgatcgatggccccctgtcctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgaaggatctggctctgtgtctctggccctgcatctgcagcctctgagaagcgctgctggcgctgcagctctggctctgacagtggatctgcctcctgccagctccgaggcccggaatagcgcatttgggtttcaaggccggctgctgcacctgtctgccggccagagactgggagtgcatctgcacacagaggccagagccaggcacgcctggcagctgacacagggcgctacagtgctgggcctgttcagagtgacccccgagattcctgccggcctgcctagccctagatctgaaggcggcggaggttccggaggcggaggatctgctagcacaaagggccccagcgtgttccctctggcccctagcagcaagagcacatctggcggaacagccgccctgggctgcctggtggaagattacttccccgagcccgtgaccgtgtcctggaattctggcgccctgacaagcggcgtgcacacctttccagccgtgctgcagagcagcggcctgtactctctgagcagcgtcgtgacagtgcccagcagctctctgggcacccagacctacatctgcaacgtgaaccacaagcccagcaacaccaaggtggacgagaaggtggaacccaagtcctgc

SEQ ID NO: 131 - DNA, 2154 bp, Artificial Sequence
  Dimeric hu 4-1BBL (71-254) - CH1* Fc knob chain
agagagggccctgagctgagccccgatgatcctgctggactgctggacctgcggcagggcatgtttgctcagctggtggcccagaacgtgctgctgatcgatggccccctgtcctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgaaggatctggctctgtgtctctggccctgcatctgcagcctctgagaagcgctgctggcgctgcagctctggcactgacagtggatctgcctcctgccagctccgaggcccggaatagcgcatttgggtttcaaggcaggctgctgcacctgtctgccggccagaggctgggagtgcatctgcacacagaggccagggctagacacgcctggcagctgacacagggcgctacagtgctgggcctgttcagagtgacccccgagattccagccggcctgccttctccaagaagcgaaggcggaggcggatctggcggcggaggatctagagagggacccgaactgtcccctgacgatccagccgggctgctggatctgagacagggaatgttcgcccagctggtggctcagaatgtgctgctgattgacggacctctgagctggtactccgacccagggctggcaggggtgtccctgactgggggactgtcctacaaagaagatacaaaagaactggtggtggctaaagctggggtgtactatgtgttttttcagctggaactgaggcgggtggtggctggggagggctcaggatctgtgtccctggctctgcatctgcagccactgcgctctgctgctggcgcagctgcactggctctgactgtggacctgccaccagcctctagcgaggccagaaacagcgccttcgggttccaaggacgcctgctgcatctgagcgccggacagcgcctgggagtgcatctgcatactgaagccagagcccggcatgcttggcagctgactcagggggcaactgtgctgggactgtttcgcgtgacacctgagatccctgccggactgccaagccctagatcagaagggggcggaggaagcggagggggaggaagtgctagcaccaagggcccctccgtgttccccctggcccccagcagcaagagcaccagcggcggcacagccgctctgggctgcctggtcgaggactacttccccgagcccgtgaccgtgtcctggaacagcggagccctgacctccggcgtgcacaccttccccgccgtgctgcagagttctggcctgtatagcctgagcagcgtggtcaccgtgccttctagcagcctgggcacccagacctacatctgcaacgtgaaccacaagcccagcaacaccaaggtggacgagaaggtggagcccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 132 - DNA, 903 bp, Artificial Sequence
  Monomeric hu 4-1BBL (71-254) -CL*
agagagggccctgagctgagccccgatgatcctgctggactgctggacctgcggcagggcatgtttgctcagctggtggcccagaacgtgctgctgatcgatggccccctgtcctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgaaggatctggctctgtgtctctggccctgcatctgcagcctctgagaagcgctgctggcgctgcagctctggcactgacagtggatctgcctcctgccagctccgaggcccggaatagcgcatttgggtttcaaggcaggctgctgcacctgtctgccggccagaggctgggagtgcatctgcacacagaggccagggctagacacgcctggcagctgacacagggcgctacagtgctgggcctgttcagagtgacccccgagattccagccggcctgccttctccaagaagcgaaggcggaggcggatctggcggcggaggatctcgtacggtggctgcaccatctgtcttcatcttcccgccatctgatcggaagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 133 - DNA, 1350 bp, Artificial Sequence
  anti-FAP (VHCL) (28H1) Fc hole chain
gaagtgcagctgctggaatccggcggaggcctggtgcagcctggcggatctctgagactgtcctgcgccgcctccggcttcaccttctcctcccacgccatgtcctgggtccgacaggctcctggcaaaggcctggaatgggtgtccgccatctgggcctccggcgagcagtactacgccgactctgtgaagggccggttcaccatctcccgggacaactccaagaacaccctgtacctgcagatgaactccctgcgggccgaggacaccgccgtgtactactgtgccaagggctggctgggcaacttcgactactggggacagggcaccctggtcaccgtgtccagcgctagcgtggccgctcccagcgtgttcatcttcccacccagcgacgagcagctgaagtccggcacagccagcgtggtgtgcctgctgaacaacttctacccccgcgaggccaaggtgcagtggaaggtggacaacgccctgcagagcggcaacagccaggaatccgtgaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgcgacaagacccacacctgtcccccttgccctgcccctgaagctgctggtggcccttccgtgttcctgttccccccaaagcccaaggacaccctgatgatcagccggacccccgaagtgacctgcgtggtggtcgatgtgtcccacgaggaccctgaagtgaagttcaattggtacgtggacggcgtggaagtgcacaatgccaagaccaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 134 - DNA, 639 bp, Artificial Sequence
  anti-FAP (VLCH1) (28H1) light chain
gagatcgtgctgacccagtctcccggcaccctgagcctgagccctggcgagagagccaccctgagctgcagagccagccagagcgtgagccggagctacctggcctggtatcagcagaagcccggccaggcccccagactgctgatcatcggcgccagcacccgggccaccggcatccccgatagattcagcggcagcggctccggcaccgacttcaccctgaccatcagccggctggaacccgaggacttcgccgtgtactactgccagcagggccaggtgatcccccccaccttcggccagggcaccaaggtggaaatcaagagcagcgcttccaccaaaggcccttccgtgtttcctctggctcctagctccaagtccacctctggaggcaccgctgctctcggatgcctcgtgaaggattattttcctgagcctgtgacagtgtcctggaatagcggagcactgacctctggagtgcatactttccccgctgtgctgcagtcctctggactgtacagcctgagcagcgtggtgacagtgcccagcagcagcctgggcacccagacctacatctgcaacgtgaaccacaagcccagcaacaccaaggtggacaagaaggtggaacccaagtcttgt

SEQ ID NO: 135 - protein, 450 aa, Artificial Sequence
  anti-FAP (VHCL) (28H1) Fc hole chain
EVQLLESGGGLVQPGGSLRLSCAASGFTFSSHAMSWVRQAPGKGLEWVSAIWASGEQYYADSVKGRFTISRDNSKNTLYLQMNSLRAEDTAVYYCAKGWLGNFDYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 136 - protein, 213 aa, Artificial Sequence
  anti-FAP (VLCH1) (28H1) light chain
EIVLTQSPGTLSLSPGERATLSCRASQSVSRSYLAWYQQKPGQAPRLLIIGASTRATGIPDRFSGSGSGTDFTLTISRLEPEDFAVYYCQQGQVIPPTFGQGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 137 - DNA, 1572 bp, Artificial Sequence
  Monomeric hu 4-1BBL (71-254) - CH1* Fc knob chain
agagagggccctgagctgagccccgatgatcctgctggactgctggacctgcggcagggcatgtttgctcagctggtggcccagaacgtgctgctgatcgatggccccctgtcctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgaaggatctggctctgtgtctctggccctgcatctgcagcctctgagaagcgctgctggcgctgcagctctggctctgacagtggatctgcctcctgccagctccgaggcccggaatagcgcatttgggtttcaaggccggctgctgcacctgtctgccggccagagactgggagtgcatctgcacacagaggccagagccaggcacgcctggcagctgacacagggcgctacagtgctgggcctgttcagagtgacccccgagattcctgccggcctgcctagccctagatctgaaggcggcggaggttccggaggcggaggatctgctagcaccaagggcccctccgtgttccccctggcccccagcagcaagagcaccagcggcggcacagccgctctgggctgcctggtcgaggactacttccccgagcccgtgaccgtgtcctggaacagcggagccctgacctccggcgtgcacaccttccccgccgtgctgcagagttctggcctgtatagcctgagcagcgtggtcaccgtgccttctagcagcctgggcacccagacctacatctgcaacgtgaaccacaagcccagcaacaccaaggtggacgagaaggtggagcccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 138 - DNA, 1485 bp, Artificial Sequence
  Dimeric hu 4-1BBL (71-254) -CL*
agagagggccctgagctgagccccgatgatcctgctggactgctggacctgcggcagggcatgtttgctcagctggtggcccagaacgtgctgctgatcgatggccccctgtcctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgaaggatctggctctgtgtctctggccctgcatctgcagcctctgagaagcgctgctggcgctgcagctctggcactgacagtggatctgcctcctgccagctccgaggcccggaatagcgcatttgggtttcaaggcaggctgctgcacctgtctgccggccagaggctgggagtgcatctgcacacagaggccagggctagacacgcctggcagctgacacagggcgctacagtgctgggcctgttcagagtgacccccgagattccagccggcctgccttctccaagaagcgaaggcggaggcggatctggcggcggaggatctagagagggacccgaactgtcccctgacgatccagccgggctgctggatctgagacagggaatgttcgcccagctggtggctcagaatgtgctgctgattgacggacctctgagctggtactccgacccagggctggcaggggtgtccctgactgggggactgtcctacaaagaagatacaaaagaactggtggtggctaaagctggggtgtactatgtgttttttcagctggaactgaggcgggtggtggctggggagggctcaggatctgtgtccctggctctgcatctgcagccactgcgctctgctgctggcgcagctgcactggctctgactgtggacctgccaccagcctctagcgaggccagaaacagcgccttcgggttccaaggacgcctgctgcatctgagcgccggacagcgcctgggagtgcatctgcatactgaagccagagcccggcatgcttggcagctgactcagggggcaactgtgctgggactgtttcgcgtgacacctgagatccctgccggactgccaagccctagatcagaagggggcggaggttccggagggggaggatctcgtacggtggctgcaccatctgtcttcatcttcccgccatctgatcggaagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 139 - protein, 718 aa, Artificial Sequence; identical to SEQ ID NO: 108
  Monomeric hu 4-1BBL (71-254) - CL* Fc knob chain

SEQ ID NO: 140 - protein, 495 aa, Artificial Sequence
  Dimeric hu 4-1BBL (71-254) -CL*
REGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 141 - DNA, 2499 bp, Artificial Sequence
  anti-FAP (28H1) Fc hole chain fused to dimeric hu 4-1BBL (71-254)
gaagtgcagctgctggaatccggcggaggcctggtgcagcctggcggatctctgagactgtcctgcgccgcctccggcttcaccttctcctcccacgccatgtcctgggtccgacaggctcctggcaaaggcctggaatgggtgtccgccatctgggcctccggcgagcagtactacgccgactctgtgaagggccggttcaccatctcccgggacaactccaagaacaccctgtacctgcagatgaactccctgcgggccgaggacaccgccgtgtactactgtgccaagggctggctgggcaacttcgactactggggacagggcaccctggtcaccgtgtccagcgctagcaccaagggcccctccgtgttccccctggcccccagcagcaagagcaccagcggcggcacagccgctctgggctgcctggtcaaggactacttccccgagcccgtgaccgtgtcctggaacagcggagccctgacctccggcgtgcacaccttccccgccgtgctgcagagttctggcctgtatagcctgagcagcgtggtcaccgtgccttctagcagcctgggcacccagacctacatctgcaacgtgaaccacaagcccagcaacaccaaggtggacaagaaggtggagcccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtggaggcggcggaagcggaggaggaggatccagagagggccctgagctgagccccgatgatcctgctggactgctggacctgcggcagggcatgtttgctcagctggtggcccagaacgtgctgctgatcgatggccccctgtcctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgaaggatctggctctgtgtctctggccctgcatctgcagcctctgagaagcgctgctggcgctgcagctctggcactgacagtggatctgcctcctgccagctccgaggcccggaatagcgcatttgggtttcaaggcaggctgctgcacctgtctgccggccagaggctgggagtgcatctgcacacagaggccagggctagacacgcctggcagctgacacagggcgctacagtgctgggcctgttcagagtgacccccgagattccagccggcctgccttctccaagaagcgaaggcggaggcggatctggcggcggaggatctagagagggacccgaactgtcccctgacgatccagccgggctgctggatctgagacagggaatgttcgcccagctggtggctcagaatgtgctgctgattgacggacctctgagctggtactccgacccagggctggcaggggtgtccctgactgggggactgtcctacaaagaagatacaaaagaactggtggtggctaaagctggggtgtactatgtgttttttcagctggaactgaggcgggtggtggctggggagggctcaggatctgtgtccctggctctgcatctgcagccactgcgctctgctgctggcgcagctgcactggctctgactgtggacctgccaccagcctctagcgaggccagaaacagcgccttcgggttccaaggacgcctgctgcatctgagcgccggacagcgcctgggagtgcatctgcatactgaagccagagcccggcatgcttggcagctgactcagggggcaactgtgctgggactgtttcgcgtgacacctgagatccctgccggactgccaagccctagatcagaa

SEQ ID NO: 142 - DNA, 1917 bp, Artificial Sequence
  anti-FAP (28H1) Fc knob chain fused to monomeric hu 4-1BBL (71-254)
gaagtgcagctgctggaatccggcggaggcctggtgcagcctggcggatctctgagactgtcctgcgccgcctccggcttcaccttctcctcccacgccatgtcctgggtccgacaggctcctggcaaaggcctggaatgggtgtccgccatctgggcctccggcgagcagtactacgccgactctgtgaagggccggttcaccatctcccgggacaactccaagaacaccctgtacctgcagatgaactccctgcgggccgaggacaccgccgtgtactactgtgccaagggctggctgggcaacttcgactactggggacagggcaccctggtcaccgtgtccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccctgcagagatgagctgaccaagaaccaggtgtccctgtggtgtctggtcaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgagccccggcggaggcggcggaagcggaggaggaggatccagagagggccctgagctgagccccgatgatcctgctggactgctggacctgcggcagggcatgtttgctcagctggtggcccagaacgtgctgctgatcgatggccccctgtcctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgaaggatctggctctgtgtctctggccctgcatctgcagcctctgagaagcgctgctggcgctgcagctctggcactgacagtggatctgcctcctgccagctccgaggcccggaatagcgcatttgggtttcaaggcaggctgctgcacctgtctgccggccagaggctgggagtgcatctgcacacagaggccagggctagacacgcctggcagctgacacagggcgctacagtgctgggcctgttcagagtgacccccgagattccagccggcctgccttctccaagaagcgaa

SEQ ID NO: 143 - DNA, 888 bp, Artificial Sequence
  Monomeric hu 4-1BBL (71-254) -(G4S)1- CL*
agagagggccctgagctgagccccgatgatcctgctggactgctggacctgcggcagggcatgtttgctcagctggtggcccagaacgtgctgctgatcgatggccccctgtcctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgaaggatctggctctgtgtctctggccctgcatctgcagcctctgagaagcgctgctggcgctgcagctctggcactgacagtggatctgcctcctgccagctccgaggcccggaatagcgcatttgggtttcaaggcaggctgctgcacctgtctgccggccagaggctgggagtgcatctgcacacagaggccagggctagacacgcctggcagctgacacagggcgctacagtgctgggcctgttcagagtgacccccgagattccagccggcctgccttctccaagaagcgaaggcggaggcggatctcgtacggtggctgcaccatctgtcttcatcttcccgccatctgatcggaagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 144 - DNA, 2028 bp, Artificial Sequence
  [anti-FAP (28H1)]2  Fc hole chain
gaagtgcagctgctggaatccggcggaggcctggtgcagcctggcggatctctgagactgtcctgcgccgcctccggcttcaccttctcctcccacgccatgtcctgggtccgacaggctcctggcaaaggcctggaatgggtgtccgccatctgggcctccggcgagcagtactacgccgactctgtgaagggccggttcaccatctcccgggacaactccaagaacaccctgtacctgcagatgaactccctgcgggccgaggacaccgccgtgtactactgtgccaagggctggctgggcaacttcgactactggggacagggcaccctggtcaccgtgtccagcgctagcacaaagggacctagcgtgttccccctggcccccagcagcaagtctacatctggcggaacagccgccctgggctgcctcgtgaaggactactttcccgagcccgtgaccgtgtcctggaactctggcgctctgacaagcggcgtgcacacctttccagccgtgctgcagagcagcggcctgtactctctgagcagcgtcgtgacagtgcccagcagctctctgggcacccagacctacatctgcaacgtgaaccacaagcccagcaacaccaaggtggacaagaaggtggaacccaagagctgcgacggcggagggggatctggcggcggaggatccgaagtgcagctgctggaatccggcggaggcctggtgcagcctggcggatctctgagactgtcctgcgccgcctccggcttcaccttctcctcccacgccatgtcctgggtccgacaggctcctggcaaaggcctggaatgggtgtccgccatctgggcctccggcgagcagtactacgccgactctgtgaagggccggttcaccatctcccgggacaactccaagaacaccctgtacctgcagatgaactccctgcgggccgaggacaccgccgtgtactactgtgccaagggctggctgggcaacttcgactactggggacagggcaccctggtcaccgtgtccagcgctagcaccaagggcccctccgtgttccccctggcccccagcagcaagagcaccagcggcggcacagccgctctgggctgcctggtcaaggactacttccccgagcccgtgaccgtgtcctggaacagcggagccctgacctccggcgtgcacaccttccccgccgtgctgcagagttctggcctgtatagcctgagcagcgtggtcaccgtgccttctagcagcctgggcacccagacctacatctgcaacgtgaaccacaagcccagcaacaccaaggtggacaagaaggtggagcccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 145 - protein, 676 aa, Artificial Sequence
  [anti-FAP (28H1)]2  Fc hole chain
EVQLLESGGGLVQPGGSLRLSCAASGFTFSSHAMSWVRQAPGKGLEWVSAIWASGEQYYADSVKGRFTISRDNSKNTLYLQMNSLRAEDTAVYYCAKGWLGNFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSEVQLLESGGGLVQPGGSLRLSCAASGFTFSSHAMSWVRQAPGKGLEWVSAIWASGEQYYADSVKGRFTISRDNSKNTLYLQMNSLRAEDTAVYYCAKGWLGNFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 146 - DNA, 2514 bp, Artificial Sequence
  Dimeric hu 4-1BBL (71-254) - FAP (VHCL*) Fc knob chain
agagagggccctgagctgagccccgatgatcctgctggactgctggacctgcggcagggcatgtttgctcagctggtggcccagaacgtgctgctgatcgatggccccctgtcctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgaaggatctggctctgtgtctctggccctgcatctgcagcctctgagaagcgctgctggcgctgcagctctggcactgacagtggatctgcctcctgccagctccgaggcccggaatagcgcatttgggtttcaaggcaggctgctgcacctgtctgccggccagaggctgggagtgcatctgcacacagaggccagggctagacacgcctggcagctgacacagggcgctacagtgctgggcctgttcagagtgacccccgagattccagccggcctgccttctccaagaagcgaaggcggaggcggatctggcggcggaggatctagagagggacccgaactgtcccctgacgatccagccgggctgctggatctgagacagggaatgttcgcccagctggtggctcagaatgtgctgctgattgacggacctctgagctggtactccgacccagggctggcaggggtgtccctgactgggggactgtcctacaaagaagatacaaaagaactggtggtggctaaagctggggtgtactatgtgttttttcagctggaactgaggcgggtggtggctggggagggctcaggatctgtgtccctggctctgcatctgcagccactgcgctctgctgctggcgcagctgcactggctctgactgtggacctgccaccagcctctagcgaggccagaaacagcgccttcgggttccaaggacgcctgctgcatctgagcgccggacagcgcctgggagtgcatctgcatactgaagccagagcccggcatgcttggcagctgactcagggggcaactgtgctgggactgtttcgcgtgacacctgagatccctgccggactgccaagccctagatcagaagggggcggaggttccggaggcggaggatctgaggtgcagctgctggaatccggcggaggcctggtgcagcctggcggatctctgagactgtcctgcgccgcctccggcttcaccttctcctcccacgccatgtcctgggtccgacaggctcctggcaaaggcctggaatgggtgtccgccatctgggcctccggcgagcagtactacgccgactctgtgaagggccggttcaccatctcccgggacaactccaagaacaccctgtacctgcagatgaactccctgcgggccgaggacaccgccgtgtactactgtgccaagggctggctgggcaacttcgactactggggccagggcaccctggtcaccgtgtccagcgctagcgtggctgcaccatctgtctttatcttcccacccagcgaccggaagctgaagtctggcacagccagcgtcgtgtgcctgctgaataacttctacccccgcgaggccaaggtgcagtggaaggtggacaatgccctgcagagcggcaacagccaggaaagcgtgaccgagcaggacagcaaggactccacctacagcctgagcagcaccctgaccctgagcaaggccgactacgagaagcacaaggtgtacgcctgcgaagtgacccaccagggcctgtctagccccgtgaccaagagcttcaaccggggcgagtgcgacaagacccacacctgtcctccatgccctgcccctgaagctgctggcggccctagcgtgttcctgttccccccaaagcccaaggacaccctgatgatcagccggacccctgaagtgacctgcgtggtggtggatgtgtcccacgaggaccctgaagtgaagttcaattggtacgtggacggcgtggaagtgcacaatgccaagaccaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 147 - DNA, 1221 bp, Artificial Sequence
  Monomeric hu 4-1BBL (71-254) -FAP (VLCH1*)
agagagggccctgagctgagccccgatgatcctgctggactgctggacctgcggcagggcatgtttgctcagctggtggcccagaacgtgctgctgatcgatggccccctgtcctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgaaggatctggctctgtgtctctggccctgcatctgcagcctctgagaagcgctgctggcgctgcagctctggctctgacagtggatctgcctcctgccagctccgaggcccggaatagcgcatttgggtttcaaggccggctgctgcacctgtctgccggccagagactgggagtgcatctgcacacagaggccagagccaggcacgcctggcagctgacacagggcgctacagtgctgggcctgttcagagtgacccccgagattcctgccggcctgcctagccctagatctgaaggcggcggaggttccggaggcggaggatctgagatcgtgctgacccagtctcccggcaccctgagcctgagccctggcgagagagccaccctgagctgcagagccagccagagcgtgagccggagctacctggcctggtatcagcagaagcccggccaggcccccagactgctgatcatcggcgccagcacccgggccaccggcatccccgatagattcagcggcagcggctccggcaccgacttcaccctgaccatcagccggctggaacccgaggacttcgccgtgtactactgccagcagggccaggtgatcccccccaccttcggccagggcaccaaggtggaaatcaagtcctctgctagcacaaagggccccagcgtgttccctctggcccctagcagcaagagcacatctggcggaacagccgccctgggctgcctggtggaagattacttccccgagcccgtgaccgtgtcctggaattctggcgccctgacaagcggcgtgcacacctttccagccgtgctgcagagcagcggcctgtactctctgagcagcgtcgtgacagtgcccagcagctctctgggcacccagacctacatctgcaacgtgaaccacaagcccagcaacaccaaggtggacgagaaggtggaacccaagtcctgc

SEQ ID NO: 148 - protein, 838 aa, Artificial Sequence
  Dimeric hu 4-1BBL (71-254) - FAP (VHCL*) Fc knob chain
REGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSEVQLLESGGGLVQPGGSLRLSCAASGFTFSSHAMSWVRQAPGKGLEWVSAIWASGEQYYADSVKGRFTISRDNSKNTLYLQMNSLRAEDTAVYYCAKGWLGNFDYWGQGTLVTVSSASVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGECDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 149 - protein, 407 aa, Artificial Sequence
  Monomeric hu 4-1BBL (71-254) -FAP (VLCH1*)
REGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSEIVLTQSPGTLSLSPGERATLSCRASQSVSRSYLAWYQQKPGQAPRLLIIGASTRATGIPDRFSGSGSGTDFTLTISRLEPEDFAVYYCQQGQVIPPTFGQGTKVEIKSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSC

SEQ ID NO: 150 - DNA, 2268 bp, Artificial Sequence
  Dimeric hu 4-1BBL (52-254) - CH1* Fc knob chain
ccttgggctgtgtctggcgctagagcctctcctggatctgccgccagccccagactgagagagggacctgagctgagccccgatgatcctgccggactgctggatctgagacagggcatgttcgcccagctggtggcccagaacgtgctgctgatcgatggccccctgtcctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgagggatctggatctgtgtctctggccctgcatctgcagcccctgagaagcgctgctggcgctgcagctctggcactgacagtggatctgcctcctgccagctccgaggcccggaatagcgcatttgggtttcaaggcagactgctgcacctgtctgccggccagaggctgggagtgcatctgcacacagaggccagggctagacacgcctggcagctgacacagggcgctacagtgctgggcctgttcagagtgacccccgagattccagccggactgcccagccctagatctgaaggcggcggaggaagcggaggcggaggatccccttgggctgtgtctggcgctagagcctctcctggatctgccgccagccccagactgagagagggacctgagctgagccccgatgatcctgccggactgctggacctgcggcagggaatgttcgctcagctggtggctcagaatgtgctgctgattgacggacctctgtcctggtactccgaccctggcctggcaggggtgtccctgactgggggactgtcctacaaagaagatacaaaagaactggtggtggctaaagctggggtgtactatgtgttttttcagctggaactgaggcgggtggtggctggggagggctcaggatctgtgtccctggctctgcatctgcagcctctgcgctctgctgctggcgcagctgcactggctctgactgtggacctgccaccagcctctagcgaggccagaaacagcgccttcgggttccaaggacggctgctgcatctgagcgccggacagcgcctgggagtgcatctgcatactgaagccagagcccggcatgcttggcagctgacccagggggcaactgtgctgggactgtttcgcgtgacacctgagatccccgctggcctgcctagcccaagaagtgaagggggaggcggatctggcggagggggatctgctagcaccaagggcccctccgtgttccccctggcccccagcagcaagagcaccagcggcggcacagccgctctgggctgcctggtcgaggactacttccccgagcccgtgaccgtgtcctggaacagcggagccctgacctccggcgtgcacaccttccccgccgtgctgcagagttctggcctgtatagcctgagcagcgtggtcaccgtgccttctagcagcctgggcacccagacctacatctgcaacgtgaaccacaagcccagcaacaccaaggtggacgagaaggtggagcccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 151 - DNA, 960 bp, Artificial Sequence
  Monomeric hu 4-1BBL (52-254) -CL*
ccttgggctgtgtctggcgctagagcctctcctggatctgccgccagccccagactgagagagggacctgagctgagccccgatgatcctgccggactgctggatctgagacagggcatgttcgcccagctggtggcccagaacgtgctgctgatcgatggccccctgtcctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgagggatctggatctgtgtctctggccctgcatctgcagcccctgagaagcgctgctggcgctgcagctctggcactgacagtggatctgcctcctgccagctccgaggcccggaatagcgcatttgggtttcaaggcaggctgctgcacctgtctgccggccagaggctgggagtgcatctgcacacagaggccagggctagacacgcctggcagctgacacagggcgctacagtgctgggcctgttcagagtgacccccgagattccagccggcctgccttctccaagaagcgaaggcggaggcggatctggcggcggaggatctcgtacggtggctgcaccatctgtcttcatcttcccgccatctgatcggaagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 152 - DNA, 2100 bp, Artificial Sequence
  Dimeric hu 4-1BBL (80-254) - CH1* Fc knob chain
gatcctgccggcctgctggatctgcggcagggaatgtttgcccagctggtggcccagaacgtgctgctgatcgatggccccctgagctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgaaggatctggctctgtgtctctggccctgcatctgcagcccctgagaagcgctgctggcgctgcagctctggcactgacagtggatctgcctcctgccagctccgaggcccggaatagcgcatttgggtttcaaggcagactgctgcacctgtctgccggccagaggctgggagtgcatctgcacacagaggccagggctagacacgcctggcagctgacacagggcgctacagtgctgggcctgttcagagtgacccccgagattccagccggactgcccagccctagatctgaaggcggcggaggaagcggaggcggaggatccgacccagctggactgctggacctgcggcagggaatgttcgctcagctggtggctcagaatgtgctgctgattgacggacctctgtcctggtactccgaccctggcctggcaggggtgtccctgactgggggactgtcctacaaagaagatacaaaagaactggtggtggctaaagctggggtgtactatgtgttttttcagctggaactgaggcgggtggtggctggggagggctcaggatctgtgtccctggctctgcatctgcagcctctgcgctctgctgctggcgcagctgcactggctctgactgtggacctgccaccagcctctagcgaggccagaaacagcgccttcgggttccaaggacggctgctgcatctgagcgccggacagcgcctgggagtgcatctgcatactgaagccagagcccggcatgcttggcagctgacccagggggcaactgtgctgggactgtttcgcgtgacacctgagatccccgctggcctgcctagcccaagaagtgaagggggaggcggatctggcggagggggatctgctagcaccaagggcccctccgtgttccccctggcccccagcagcaagagcaccagcggcggcacagccgctctgggctgcctggtcgaggactacttccccgagcccgtgaccgtgtcctggaacagcggagccctgacctccggcgtgcacaccttccccgccgtgctgcagagttctggcctgtatagcctgagcagcgtggtcaccgtgccttctagcagcctgggcacccagacctacatctgcaacgtgaaccacaagcccagcaacaccaaggtggacgagaaggtggagcccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 153 - DNA, 876 bp, Artificial Sequence
  Monomeric hu 4-1BBL (80-254) -CL*
gatcctgccggcctgctggatctgcggcagggaatgtttgcccagctggtggcccagaacgtgctgctgatcgatggccccctgagctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgaaggatctggctctgtgtctctggccctgcatctgcagcccctgagaagcgctgctggcgctgcagctctggcactgacagtggatctgcctcctgccagctccgaggcccggaatagcgcatttgggtttcaaggcaggctgctgcacctgtctgccggccagaggctgggagtgcatctgcacacagaggccagggctagacacgcctggcagctgacacagggcgctacagtgctgggcctgttcagagtgacccccgagattccagccggcctgccttctccaagaagcgaaggcggaggcggatctggcggcggaggatctcgtacggtggctgcaccatctgtcttcatcttcccgccatctgatcggaagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 154 - DNA, 1317 bp, Artificial Sequence
  DP47 Fc KK chain DNA
gaggtgcaattgttggagtctgggggaggcttggtacagcctggggggtccctgagactctcctgtgcagcctccggattcacctttagcagttatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcagatgaacagcctgagagccgaggacacggccgtatattactgtgcgaaaggcagcggatttgactactggggccaaggaaccctggtcaccgtctcgagcgctaagaccaccccccctagcgtgtaccctctggcccctggatctgccgcccagaccaacagcatggtgaccctgggctgcctggtgaagggctacttccccgagcctgtgaccgtgacctggaacagcggcagcctgagcagcggcgtgcacacctttccagccgtgctgcagagcgacctgtacaccctgagcagctccgtgaccgtgcctagcagcacctggcccagccagacagtgacctgcaacgtggcccaccctgccagcagcaccaaggtggacaagaaaatcgtgccccgggactgcggctgcaagccctgcatctgcaccgtgcccgaggtgtccagcgtgttcatcttcccacccaagcccaaggacgtgctgaccatcaccctgacccccaaagtgacctgcgtggtggtggccatcagcaaggacgaccccgaggtgcagttctcttggtttgtggacgacgtggaggtgcacacagcccagacaaagccccgggaggaacagatcaacagcaccttcagaagcgtgtccgagctgcccatcatgcaccaggactggctgaacggcaaagaattcaagtgcagagtgaacagcgccgccttcggcgcccccatcgagaaaaccatcagcaagaccaagggcagacccaaggccccccaggtgtacaccatccccccacccaaaaaacagatggccaaggacaaggtgtccctgacctgcatgatcaccaactttttccccgaggacatcaccgtggagtggcagtggaatggccagcccgccgagaactacaagaacacccagcccatcatgaagaccgacggcagctacttcgtgtacagcaagctgaacgtgcagaagtccaactgggaggccggcaacaccttcacctgtagcgtgctgcacgagggcctgcacaaccaccacaccgagaagtccctgagccactcccccggcaag

SEQ ID NO: 155 - DNA, 645 bp, Artificial Sequence
  DP47 light chain DNA
gaaatcgtgttaacgcagtctccaggcaccctgtctttgtctccaggggaaagagccaccctctcttgcagggccagtcagagtgttagcagcagctacttagcctggtaccagcagaaacctggccaggctcccaggctcctcatctatggagcatccagcagggccactggcatcccagacaggttcagtggcagtggatccgggacagacttcactctcaccatcagcagactggagcctgaagattttgcagtgtattactgtcagcagtatggtagctcaccgctgacgttcggccaggggaccaaagtggaaatcaaacgtgccgatgctgcaccaactgtatcgattttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 156 - protein, 439 aa, Artificial Sequence
  DP47 Fc KK chain
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGSGFDYWGQGTLVTVSSAKTTPPSVYPLAPGSAAQTNSMVTLGCLVKGYFPEPVTVTWNSGSLSSGVHTFPAVLQSDLYTLSSSVTVPSSTWPSQTVTCNVAHPASSTKVDKKIVPRDCGCKPCICTVPEVSSVFIFPPKPKDVLTITLTPKVTCVVVAISKDDPEVQFSWFVDDVEVHTAQTKPREEQINSTFRSVSELPIMHQDWLNGKEFKCRVNSAAFGAPIEKTISKTKGRPKAPQVYTIPPPKKQMAKDKVSLTCMITNFFPEDITVEWQWNGQPAENYKNTQPIMKTDGSYFVYSKLNVQKSNWEAGNTFTCSVLHEGLHNHHTEKSLSHSPGK

SEQ ID NO: 157 - protein, 215 aa, Artificial Sequence
  DP47 light chain
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGQGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 158 - DNA, 2298 bp, Artificial Sequence
  Dimeric murine  4-1BBL (104-309, C160S) - CL Fc DD chain DNA
agaaccgagcccagacccgccctgaccatcaccaccagccctaacctgggcaccagagagaacaacgccgaccaagtgacccccgtgtcccacatcggctgccccaataccacacagcagggcagccctgtgttcgccaagctgctggccaagaaccaggccagcctgagcaacaccaccctgaactggcacagccaggatggcgccggaagcagctatctgagccagggcctgagatacgaagaggacaagaaagaactggtggtggacagccctggcctgtactacgtgttcctggaactgaagctgagccccaccttcaccaacaccggccacaaggtgcagggctgggtgtcactggtgctgcaggccaaaccccaggtggacgacttcgacaacctggccctgaccgtggaactgttcccctgcagcatggaaaacaagctggtggatcggagctggtcccagcttctgctgctgaaggccggacacagactgagcgtgggcctgagggcttatctgcacggcgcccaggacgcctacagagactgggagctgagctaccccaacacaaccagcttcggcctgttcctcgtgaagcccgacaacccttgggaaggcggcggaggctccggaggaggcggatctagaacagagcctcggcctgccctgacaattaccacatcccccaatctgggcacccgggaaaacaatgcagatcaagtgacacctgtgtctcatattgggtgccccaacactacccagcaggggtccccagtgtttgctaaactgctggctaaaaatcaggcctccctgtctaacacaacactgaattggcatagtcaggacggggctggcagcagctacctgtctcagggactgcgctatgaggaagataagaaagaactggtggtggattcccccggactgtactatgtgtttctggaactgaaactgtcccctacctttacaaataccgggcacaaagtgcagggatgggtgtccctggtgctgcaggctaagcctcaggtggacgattttgataatctggctctgacagtggaactgtttccttgctctatggaaaacaaactggtggaccgctcttggagccagttgctgctgctgaaagctggccaccggctgtctgtgggactgagagcatacctgcatggggcacaggatgcctaccgggattgggaactgtcctaccctaacactacttccttcggactgttcctcgtgaaacctgataatccctgggagggcggaggcggaagtggcggagggggatccagagctgatgctgcccctaccgtgtccatcttcccacccagcagcgagcagctgacatctgggggagctagcgtcgtgtgcttcctgaacaacttctaccccaaggacatcaacgtgaagtggaagatcgacggcagcgagcggcagaacggcgtgctgaatagctggaccgaccaggacagcaaggactccacctacagcatgagcagcaccctgaccctgaccaaggacgagtacgagcggcacaacagctacacatgcgaggccacccacaagaccagcaccagccccatcgtgaagtccttcaaccggaacgagtgcgtgcccagagactgcggctgcaagccttgcatctgcaccgtgcctgaggtgtccagcgtgttcatcttcccacccaagcccaaggacgtgctgaccatcaccctgacacccaaagtgacctgcgtggtggtggccatcagcaaggatgaccccgaggtgcagttcagttggttcgtggacgacgtggaagtgcacaccgctcagaccaagcccagagaggaacagatcaacagcaccttcagaagcgtgtccgagctgcccatcatgcaccaggactggctgaacggcaaagaattcaagtgcagagtgaacagcgccgcctttggcgcccctatcgagaaaaccatctccaagaccaagggcagacccaaggccccccaggtgtacacaatccccccacccaaagaacagatggccaaggacaaggtgtccctgacctgcatgatcaccaatttcttcccagaggatatcaccgtggaatggcagtggaacggccagcccgccgagaactacgacaacacccagcctatcatggacaccgacggctcctacttcgtgtacagcgacctgaacgtgcagaagtccaactgggaggccggcaacaccttcacctgtagcgtgctgcacgagggcctgcacaaccaccacaccgagaagtccctgtcccacagccctggcaag

SEQ ID NO: 159 - DNA, 954 bp, Artificial Sequence
  Monomeric murine 4-1BBL (104-309, C160S) - CH1 DNA
agaaccgagcccagacccgccctgaccatcaccaccagccctaacctgggcaccagagagaacaacgccgaccaagtgacccccgtgtcccacatcggctgccccaataccacacagcagggcagccctgtgttcgccaagctgctggccaagaaccaggccagcctgagcaacaccaccctgaactggcacagccaggatggcgccggaagcagctatctgagccagggcctgagatacgaagaggacaagaaagaactggtggtggacagccctggcctgtactacgtgttcctggaactgaagctgagccccaccttcaccaacaccggccacaaggtgcagggctgggtgtcactggtgctgcaggccaaaccccaggtggacgacttcgacaacctggccctgaccgtggaactgttcccctgcagcatggaaaacaagctggtggatcggagctggtcccagcttctgctgctgaaggccggacacagactgagcgtgggcctgagggcttatctgcacggcgcccaggacgcctacagagactgggagctgagctaccccaacacaaccagcttcggcctgttcctcgtgaagcccgacaacccttgggaaggcggcggaggctccggaggaggcggaagcgctaagaccaccccccccagcgtgtaccctctggcccctggatctgccgcccagaccaacagcatggtgaccctgggctgcctggtgaagggctacttccccgagcctgtgaccgtgacctggaacagcggcagcctgagcagcggcgtgcacacctttccagccgtgctgcagagcgacctgtacaccctgagcagctccgtgaccgtgcctagcagcacctggcccagccagacagtgacctgcaacgtggcccaccctgccagcagcaccaaggtggacaagaaaatcgtgccccgggactgc

SEQ ID NO: 160 - protein, 766 aa, Artificial Sequence
  Dimeric murine  4-1BBL (104-309, C160S) - CL Fc DD chain
RTEPRPALTITTSPNLGTRENNADQVTPVSHIGCPNTTQQGSPVFAKLLAKNQASLSNTTLNWHSQDGAGSSYLSQGLRYEEDKKELVVDSPGLYYVFLELKLSPTFTNTGHKVQGWVSLVLQAKPQVDDFDNLALTVELFPCSMENKLVDRSWSQLLLLKAGHRLSVGLRAYLHGAQDAYRDWELSYPNTTSFGLFLVKPDNPWEGGGGSGGGGSRTEPRPALTITTSPNLGTRENNADQVTPVSHIGCPNTTQQGSPVFAKLLAKNQASLSNTTLNWHSQDGAGSSYLSQGLRYEEDKKELVVDSPGLYYVFLELKLSPTFTNTGHKVQGWVSLVLQAKPQVDDFDNLALTVELFPCSMENKLVDRSWSQLLLLKAGHRLSVGLRAYLHGAQDAYRDWELSYPNTTSFGLFLVKPDNPWEGGGGSGGGGSRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNECVPRDCGCKPCICTVPEVSSVFIFPPKPKDVLTITLTPKVTCVVVAISKDDPEVQFSWFVDDVEVHTAQTKPREEQINSTFRSVSELPIMHQDWLNGKEFKCRVNSAAFGAPIEKTISKTKGRPKAPQVYTIPPPKEQMAKDKVSLTCMITNFFPEDITVEWQWNGQPAENYDNTQPIMDTDGSYFVYSDLNVQKSNWEAGNTFTCSVLHEGLHNHHTEKSLSHSPGK

SEQ ID NO: 161 - protein, 318 aa, Artificial Sequence
  Monomeric murine 4-1BBL (104-309, C160S) - CH1
RTEPRPALTITTSPNLGTRENNADQVTPVSHIGCPNTTQQGSPVFAKLLAKNQASLSNTTLNWHSQDGAGSSYLSQGLRYEEDKKELVVDSPGLYYVFLELKLSPTFTNTGHKVQGWVSLVLQAKPQVDDFDNLALTVELFPCSMENKLVDRSWSQLLLLKAGHRLSVGLRAYLHGAQDAYRDWELSYPNTTSFGLFLVKPDNPWEGGGGSGGGGSAKTTPPSVYPLAPGSAAQTNSMVTLGCLVKGYFPEPVTVTWNSGSLSSGVHTFPAVLQSDLYTLSSSVTVPSSTWPSQTVTCNVAHPASSTKVDKKIVPRDC

SEQ ID NO: 162 - DNA, 1341 bp, Artificial Sequence
  anti-FAP (4B9) Fc hole chain DNA
gaggtgcagctgctcgaaagcggcggaggactggtgcagcctggcggcagcctgagactgtcttgcgccgccagcggcttcaccttcagcagctacgccatgagctgggtccgccaggcccctggcaagggactggaatgggtgtccgccatcatcggctctggcgccagcacctactacgccgacagcgtgaagggccggttcaccatcagccgggacaacagcaagaacaccctgtacctgcagatgaacagcctgcgggccgaggacaccgccgtgtactactgcgccaagggatggttcggcggcttcaactactggggacagggcaccctggtcacagtgtccagcgctagcaccaagggcccctccgtgttccccctggcccccagcagcaagagcaccagcggcggcacagccgctctgggctgcctggtcaaggactacttccccgagcccgtgaccgtgtcctggaacagcggagccctgacctccggcgtgcacaccttccccgccgtgctgcagagttctggcctgtatagcctgagcagcgtggtcaccgtgccttctagcagcctgggcacccagacctacatctgcaacgtgaaccacaagcccagcaacaccaaggtggacaagaaggtggagcccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 163 - DNA, 645 bp, Artificial Sequence
  anti-FAP (4B9) light chain DNA
gagatcgtgctgacccagtcccccggcaccctgtctctgagccctggcgagagagccaccctgtcctgcagagcctcccagtccgtgacctcctcctacctcgcctggtatcagcagaagcccggccaggcccctcggctgctgatcaacgtgggcagtcggagagccaccggcatccctgaccggttctccggctctggctccggcaccgacttcaccctgaccatctcccggctggaacccgaggacttcgccgtgtactactgccagcagggcatcatgctgccccccacctttggccagggcaccaaggtggaaatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 164 - protein, 447 aa, Artificial Sequence
  anti-FAP (4B9) Fc hole chain
EVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 165 - DNA, 2166 bp, Artificial Sequence
  Dimeric hu 4-1BBL (71-254) - CL Fc knob chain DNA
agagagggccctgagctgagccccgatgatcctgctggactgctggacctgcggcagggcatgtttgctcagctggtggcccagaacgtgctgctgatcgatggccccctgtcctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgaaggatctggctctgtgtctctggccctgcatctgcagcctctgagaagcgctgctggcgctgcagctctggcactgacagtggatctgcctcctgccagctccgaggcccggaatagcgcatttgggtttcaaggcaggctgctgcacctgtctgccggccagaggctgggagtgcatctgcacacagaggccagggctagacacgcctggcagctgacacagggcgctacagtgctgggcctgttcagagtgacccccgagattccagccggcctgccttctccaagaagcgaaggcggaggcggatctggcggcggaggatctagagagggacccgaactgtcccctgacgatccagccgggctgctggatctgagacagggaatgttcgcccagctggtggctcagaatgtgctgctgattgacggacctctgagctggtactccgacccagggctggcaggggtgtccctgactgggggactgtcctacaaagaagatacaaaagaactggtggtggctaaagctggggtgtactatgtgttttttcagctggaactgaggcgggtggtggctggggagggctcaggatctgtgtccctggctctgcatctgcagccactgcgctctgctgctggcgcagctgcactggctctgactgtggacctgccaccagcctctagcgaggccagaaacagcgccttcgggttccaaggacgcctgctgcatctgagcgccggacagcgcctgggagtgcatctgcatactgaagccagagcccggcatgcttggcagctgactcagggggcaactgtgctgggactgtttcgcgtgacacctgagatccctgccggactgccaagccctagatcagaagggggcggaggttccggagggggaggatctcgtacggtggccgctccctccgtgtttatctttcccccatccgatgaacagctgaaaagcggcaccgcctccgtcgtgtgtctgctgaacaatttttaccctagggaagctaaagtgcagtggaaagtggataacgcactgcagtccggcaactcccaggaatctgtgacagaacaggactccaaggacagcacctactccctgtcctccaccctgacactgtctaaggctgattatgagaaacacaaagtctacgcctgcgaagtcacccatcagggcctgagctcgcccgtcacaaagagcttcaacaggggagagtgtgacaagacccacacctgtcccccttgtcctgcccctgaagctgctggcggcccttctgtgttcctgttccccccaaagcccaaggacaccctgatgatcagccggacccccgaagtgacctgcgtggtggtggatgtgtcccacgaggaccctgaagtgaagttcaattggtacgtggacggcgtggaagtgcacaatgccaagaccaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 166 - DNA, 891 bp, Artificial Sequence
  Monomeric hu 4-1BBL (71-254) - CH1 DNA
agagagggccctgagctgagccccgatgatcctgctggactgctggacctgcggcagggcatgtttgctcagctggtggcccagaacgtgctgctgatcgatggccccctgtcctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgaaggatctggctctgtgtctctggccctgcatctgcagcctctgagaagcgctgctggcgctgcagctctggctctgacagtggatctgcctcctgccagctccgaggcccggaatagcgcatttgggtttcaaggccggctgctgcacctgtctgccggccagagactgggagtgcatctgcacacagaggccagagccaggcacgcctggcagctgacacagggcgctacagtgctgggcctgttcagagtgacccccgagattcctgccggcctgcctagccctagatctgaaggcggcggaggttccggaggcggaggatctgctagcaccaaaggcccttccgtgtttcctctggctcctagctccaagtccacctctggaggcaccgctgctctcggatgcctcgtgaaggattattttcctgagcctgtgacagtgtcctggaatagcggagcactgacctctggagtgcatactttccccgctgtgctgcagtcctctggactgtacagcctgagcagcgtggtgacagtgcccagcagcagcctgggcacccagacctacatctgcaacgtgaaccacaagcccagcaacaccaaggtggacaagaaggtggaacccaagtcttgt

SEQ ID NO: 167 - DNA, 2502 bp, Artificial Sequence
  anti-FAP (4B9) Fc hole chain fused to dimeric hu 4-1BBL (71-254) DNA
gaggtgcagctgctcgaaagcggcggaggactggtgcagcctggcggcagcctgagactgtcttgcgccgccagcggcttcaccttcagcagctacgccatgagctgggtccgccaggcccctggcaagggactggaatgggtgtccgccatcatcggctctggcgccagcacctactacgccgacagcgtgaagggccggttcaccatcagccgggacaacagcaagaacaccctgtacctgcagatgaacagcctgcgggccgaggacaccgccgtgtactactgcgccaagggatggttcggcggcttcaactactggggacagggcaccctggtcacagtgtccagcgctagcaccaagggcccctccgtgttccccctggcccccagcagcaagagcaccagcggcggcacagccgctctgggctgcctggtcaaggactacttccccgagcccgtgaccgtgtcctggaacagcggagccctgacctccggcgtgcacaccttccccgccgtgctgcagagttctggcctgtatagcctgagcagcgtggtcaccgtgccttctagcagcctgggcacccagacctacatctgcaacgtgaaccacaagcccagcaacaccaaggtggacaagaaggtggagcccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtggaggcggcggaagcggaggaggaggatccagagagggccctgagctgagccccgatgatcctgctggactgctggacctgcggcagggcatgtttgctcagctggtggcccagaacgtgctgctgatcgatggccccctgtcctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgaaggatctggctctgtgtctctggccctgcatctgcagcctctgagaagcgctgctggcgctgcagctctggcactgacagtggatctgcctcctgccagctccgaggcccggaatagcgcatttgggtttcaaggcaggctgctgcacctgtctgccggccagaggctgggagtgcatctgcacacagaggccagggctagacacgcctggcagctgacacagggcgctacagtgctgggcctgttcagagtgacccccgagattccagccggcctgccttctccaagaagcgaaggcggaggcggatctggcggcggaggatctagagagggacccgaactgtcccctgacgatccagccgggctgctggatctgagacagggaatgttcgcccagctggtggctcagaatgtgctgctgattgacggacctctgagctggtactccgacccagggctggcaggggtgtccctgactgggggactgtcctacaaagaagatacaaaagaactggtggtggctaaagctggggtgtactatgtgttttttcagctggaactgaggcgggtggtggctggggagggctcaggatctgtgtccctggctctgcatctgcagccactgcgctctgctgctggcgcagctgcactggctctgactgtggacctgccaccagcctctagcgaggccagaaacagcgccttcgggttccaaggacgcctgctgcatctgagcgccggacagcgcctgggagtgcatctgcatactgaagccagagcccggcatgcttggcagctgactcagggggcaactgtgctgggactgtttcgcgtgacacctgagatccctgccggactgccaagccctagatcagaa

SEQ ID NO: 168 - DNA, 1920 bp, Artificial Sequence
  anti-FAP (4B9) Fc knob chain fused to monomeric hu 4-1BBL (71-254) DNA
gaggtgcagctgctcgaaagcggcggaggactggtgcagcctggcggcagcctgagactgtcttgcgccgccagcggcttcaccttcagcagctacgccatgagctgggtccgccaggcccctggcaagggactggaatgggtgtccgccatcatcggctctggcgccagcacctactacgccgacagcgtgaagggccggttcaccatcagccgggacaacagcaagaacaccctgtacctgcagatgaacagcctgcgggccgaggacaccgccgtgtactactgcgccaagggatggttcggcggcttcaactactggggacagggcaccctggtcacagtgtccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccctgcagagatgagctgaccaagaaccaggtgtccctgtggtgtctggtcaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgagccccggcggaggcggcggaagcggaggaggaggatccagagagggccctgagctgagccccgatgatcctgctggactgctggacctgcggcagggcatgtttgctcagctggtggcccagaacgtgctgctgatcgatggccccctgtcctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgaaggatctggctctgtgtctctggccctgcatctgcagcctctgagaagcgctgctggcgctgcagctctggcactgacagtggatctgcctcctgccagctccgaggcccggaatagcgcatttgggtttcaaggcaggctgctgcacctgtctgccggccagaggctgggagtgcatctgcacacagaggccagggctagacacgcctggcagctgacacagggcgctacagtgctgggcctgttcagagtgacccccgagattccagccggcctgccttctccaagaagcgaa

SEQ ID NO: 169 - DNA, 2130 bp, Artificial Sequence
  Dimeric hu 4-1BBL (71-248) - CL* Fc knob chain DNA
agagagggccctgagctgagccccgatgatcctgctggactgctggacctgcggcagggcatgtttgctcagctggtggcccagaacgtgctgctgatcgatggccccctgtcctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgaaggatctggctctgtgtctctggccctgcatctgcagcctctgagatctgctgctggcgccgctgctctggcactgacagtggatctgcctcctgccagcagcgaggcccggaatagcgcatttgggtttcaaggcaggctgctgcacctgtctgccggccagaggctgggagtgcatctgcacacagaggccagggctagacacgcctggcagctgacacagggcgctacagtgctgggcctgttcagagtgacccccgagattccagccggactgggaggcggcggatctggcggcggaggatctagagaaggacccgagctgtcccctgacgatccagccgggctgctggatctgagacagggaatgttcgcccagctggtggctcagaatgtgctgctgattgacggacctctgagctggtactccgacccagggctggcaggggtgtccctgactgggggactgtcctacaaagaagatacaaaagaactggtggtggctaaagctggggtgtactatgtgttttttcagctggaactgaggcgggtggtggctggggagggctcaggatctgtgtccctggctctgcatctgcagccactgcgctctgcagcaggggctgcagcactggccctgactgtggacctgcccccagcttcttccgaggccagaaacagcgccttcgggttccaaggacgcctgctgcatctgagcgccggacagcgcctgggagtgcatctgcatactgaagccagagcccggcatgcttggcagctgactcagggggcaactgtgctgggactgtttcgcgtgacacctgagatccccgctggactgggcggaggcggttccggagggggaggatctcgtacggtggctgcaccatctgtctttatcttcccacccagcgaccggaagctgaagtctggcacagccagcgtcgtgtgcctgctgaataacttctacccccgcgaggccaaggtgcagtggaaggtggacaatgccctgcagagcggcaacagccaggaaagcgtgaccgagcaggacagcaaggactccacctacagcctgagcagcaccctgaccctgagcaaggccgactacgagaagcacaaggtgtacgcctgcgaagtgacccaccagggcctgtctagccccgtgaccaagagcttcaaccggggcgagtgcgacaagacccacacctgtcctccatgccctgcccctgaagctgctggcggccctagcgtgttcctgttccccccaaagcccaaggacaccctgatgatcagccggacccctgaagtgacctgcgtggtggtggatgtgtcccacgaggaccctgaagtgaagttcaattggtacgtggacggcgtggaagtgcacaatgccaagaccaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 170 - DNA, 873 bp, Artificial Sequence
  Monomeric hu 4-1BBL (71-248) - CH1* DNA
agagagggccctgagctgagccccgatgatcctgctggactgctggacctgcggcagggcatgtttgctcagctggtggcccagaacgtgctgctgatcgatggccccctgtcctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgaaggatctggctctgtgtctctggccctgcatctgcagcctctgagatctgctgctggcgccgctgctctggcactgacagtggatctgcctcctgccagcagcgaggcccggaatagcgcatttgggtttcaaggcaggctgctgcacctgtctgccggccagaggctgggagtgcatctgcacacagaggccagggctagacacgcctggcagctgacacagggcgctacagtgctgggcctgttcagagtgacccccgagattccagccggactgggaggcggaggttccggaggcggaggatctgctagcacaaagggccccagcgtgttccctctggcccctagcagcaagagcacatctggcggaacagccgccctgggctgcctggtggaagattacttccccgagcccgtgaccgtgtcctggaattctggcgccctgacaagcggcgtgcacacctttccagccgtgctgcagagcagcggcctgtactctctgagcagcgtcgtgacagtgcccagcagctctctgggcacccagacctacatctgcaacgtgaaccacaagcccagcaacaccaaggtggacgagaaggtggaacccaagtcctgc

SEQ ID NO: 171 - DNA, 2130 bp, Artificial Sequence
  dimeric hu 4-1BBL (71-248) - CL Fc knob chain DNA
agagagggccctgagctgagccccgatgatcctgctggactgctggacctgcggcagggcatgtttgctcagctggtggcccagaacgtgctgctgatcgatggccccctgtcctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgaaggatctggctctgtgtctctggccctgcatctgcagcctctgagatctgctgctggcgccgctgctctggcactgacagtggatctgcctcctgccagcagcgaggcccggaatagcgcatttgggtttcaaggcaggctgctgcacctgtctgccggccagaggctgggagtgcatctgcacacagaggccagggctagacacgcctggcagctgacacagggcgctacagtgctgggcctgttcagagtgacccccgagattccagccggactgggaggcggcggatctggcggcggaggatctagagaaggacccgagctgtcccctgacgatccagccgggctgctggatctgagacagggaatgttcgcccagctggtggctcagaatgtgctgctgattgacggacctctgagctggtactccgacccagggctggcaggggtgtccctgactgggggactgtcctacaaagaagatacaaaagaactggtggtggctaaagctggggtgtactatgtgttttttcagctggaactgaggcgggtggtggctggggagggctcaggatctgtgtccctggctctgcatctgcagccactgcgctctgcagcaggggctgcagcactggccctgactgtggacctgcccccagcttcttccgaggccagaaacagcgccttcgggttccaaggacgcctgctgcatctgagcgccggacagcgcctgggagtgcatctgcatactgaagccagagcccggcatgcttggcagctgactcagggggcaactgtgctgggactgtttcgcgtgacacctgagatccccgctggactgggcggaggcggttccggagggggaggatctcgtacggtggccgctccctccgtgtttatctttcccccatccgatgaacagctgaaaagcggcaccgcctccgtcgtgtgtctgctgaacaatttttaccctagggaagctaaagtgcagtggaaagtggataacgcactgcagtccggcaactcccaggaatctgtgacagaacaggactccaaggacagcacctactccctgtcctccaccctgacactgtctaaggctgattatgagaaacacaaagtctacgcctgcgaagtcacccatcagggcctgagctcgcccgtcacaaagagcttcaacaggggagagtgtgacaagacccacacctgtcccccttgtcctgcccctgaagctgctggcggcccttctgtgttcctgttccccccaaagcccaaggacaccctgatgatcagccggacccccgaagtgacctgcgtggtggtggatgtgtcccacgaggaccctgaagtgaagttcaattggtacgtggacggcgtggaagtgcacaatgccaagaccaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 172 - DNA, 873 bp, Artificial Sequence
  Monomeric hu 4-1BBL (71-248) - CH1 DNA
agagagggccctgagctgagccccgatgatcctgctggactgctggacctgcggcagggcatgtttgctcagctggtggcccagaacgtgctgctgatcgatggccccctgtcctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgaaggatctggctctgtgtctctggccctgcatctgcagcctctgagatctgctgctggcgccgctgctctggcactgacagtggatctgcctcctgccagcagcgaggcccggaatagcgcatttgggtttcaaggcaggctgctgcacctgtctgccggccagaggctgggagtgcatctgcacacagaggccagggctagacacgcctggcagctgacacagggcgctacagtgctgggcctgttcagagtgacccccgagattccagccggactgggaggcggaggttccggaggcggaggatctgctagcaccaaaggcccttccgtgtttcctctggctcctagctccaagtccacctctggaggcaccgctgctctcggatgcctcgtgaaggattattttcctgagcctgtgacagtgtcctggaatagcggagcactgacctctggagtgcatactttccccgctgtgctgcagtcctctggactgtacagcctgagcagcgtggtgacagtgcccagcagcagcctgggcacccagacctacatctgcaacgtgaaccacaagcccagcaacaccaaggtggacaagaaggtggaacccaagtcttgt

SEQ ID NO: 173 - protein, 710 aa, Artificial Sequence
  Dimeric hu 4-1BBL (71-248) - CL Fc knob chain
REGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLGGGGSGGGGSRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 174 - protein, 291 aa, Artificial Sequence
  Monomeric hu 4-1BBL (71-248) - CH1
REGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLGGGGSGGGGSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 175 - DNA, 2466 bp, Artificial Sequence
  anti-FAP (4B9) Fc hole chain fused to dimeric hu 4-1BBL (71-248) DNA
gaggtgcagctgctcgaaagcggcggaggactggtgcagcctggcggcagcctgagactgtcttgcgccgccagcggcttcaccttcagcagctacgccatgagctgggtccgccaggcccctggcaagggactggaatgggtgtccgccatcatcggctctggcgccagcacctactacgccgacagcgtgaagggccggttcaccatcagccgggacaacagcaagaacaccctgtacctgcagatgaacagcctgcgggccgaggacaccgccgtgtactactgcgccaagggatggttcggcggcttcaactactggggacagggcaccctggtcacagtgtccagcgctagcaccaagggcccctccgtgttccccctggcccccagcagcaagagcaccagcggcggcacagccgctctgggctgcctggtcaaggactacttccccgagcccgtgaccgtgtcctggaacagcggagccctgacctccggcgtgcacaccttccccgccgtgctgcagagttctggcctgtatagcctgagcagcgtggtcaccgtgccttctagcagcctgggcacccagacctacatctgcaacgtgaaccacaagcccagcaacaccaaggtggacaagaaggtggagcccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtggaggcggcggaagcggaggaggaggatccagagagggccctgagctgagccccgatgatcctgctggactgctggacctgcggcagggcatgtttgctcagctggtggcccagaacgtgctgctgatcgatggccccctgtcctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgaaggatctggctctgtgtctctggccctgcatctgcagcctctgagaagcgctgctggcgctgcagctctggcactgacagtggatctgcctcctgccagctccgaggcccggaatagcgcatttgggtttcaaggcaggctgctgcacctgtctgccggccagaggctgggagtgcatctgcacacagaggccagggctagacacgcctggcagctgacacagggcgctacagtgctgggcctgttcagagtgacccccgagattccagccggcctgggcggaggcggatctggcggcggaggatctagagagggacccgaactgtcccctgacgatccagccgggctgctggatctgagacagggaatgttcgcccagctggtggctcagaatgtgctgctgattgacggacctctgagctggtactccgacccagggctggcaggggtgtccctgactgggggactgtcctacaaagaagatacaaaagaactggtggtggctaaagctggggtgtactatgtgttttttcagctggaactgaggcgggtggtggctggggagggctcaggatctgtgtccctggctctgcatctgcagccactgcgctctgctgctggcgcagctgcactggctctgactgtggacctgccaccagcctctagcgaggccagaaacagcgccttcgggttccaaggacgcctgctgcatctgagcgccggacagcgcctgggagtgcatctgcatactgaagccagagcccggcatgcttggcagctgactcagggggcaactgtgctgggactgtttcgcgtgacacctgagatccctgccggactg

SEQ ID NO: 176 - DNA, 1902 bp, Artificial Sequence
  anti-FAP (4B9) Fc knob chain fused to monomeric hu 4-1BBL (71-248) DNA
gaggtgcagctgctcgaaagcggcggaggactggtgcagcctggcggcagcctgagactgtcttgcgccgccagcggcttcaccttcagcagctacgccatgagctgggtccgccaggcccctggcaagggactggaatgggtgtccgccatcatcggctctggcgccagcacctactacgccgacagcgtgaagggccggttcaccatcagccgggacaacagcaagaacaccctgtacctgcagatgaacagcctgcgggccgaggacaccgccgtgtactactgcgccaagggatggttcggcggcttcaactactggggacagggcaccctggtcacagtgtccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccctgcagagatgagctgaccaagaaccaggtgtccctgtggtgtctggtcaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgagccccggcggaggcggcggaagcggaggaggaggatccagagagggccctgagctgagccccgatgatcctgctggactgctggacctgcggcagggcatgtttgctcagctggtggcccagaacgtgctgctgatcgatggccccctgtcctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgaaggatctggctctgtgtctctggccctgcatctgcagcctctgagaagcgctgctggcgctgcagctctggcactgacagtggatctgcctcctgccagctccgaggcccggaatagcgcatttgggtttcaaggcaggctgctgcacctgtctgccggccagaggctgggagtgcatctgcacacagaggccagggctagacacgcctggcagctgacacagggcgctacagtgctgggcctgttcagagtgacccccgagattccagccggcctg

SEQ ID NO: 177 - DNA, 2496 bp, Artificial Sequence
  DP47 Fc hole chain fused to dimeric hu 4-1BBL (71-254) DNA
gaggtgcaattgttggagtctgggggaggcttggtacagcctggggggtccctgagactctcctgtgcagcctccggattcacctttagcagttatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcagatgaacagcctgagagccgaggacacggccgtatattactgtgcgaaaggcagcggatttgactactggggccaaggaaccctggtcaccgtctcgagtgctagcaccaagggcccctccgtgttccccctggcccccagcagcaagagcaccagcggcggcacagccgctctgggctgcctggtcaaggactacttccccgagcccgtgaccgtgtcctggaacagcggagccctgacctccggcgtgcacaccttccccgccgtgctgcagagttctggcctgtatagcctgagcagcgtggtcaccgtgccttctagcagcctgggcacccagacctacatctgcaacgtgaaccacaagcccagcaacaccaaggtggacaagaaggtggagcccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtggaggcggcggaagcggaggaggaggatccagagagggccctgagctgagccccgatgatcctgctggactgctggacctgcggcagggcatgtttgctcagctggtggcccagaacgtgctgctgatcgatggccccctgtcctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgaaggatctggctctgtgtctctggccctgcatctgcagcctctgagaagcgctgctggcgctgcagctctggcactgacagtggatctgcctcctgccagctccgaggcccggaatagcgcatttgggtttcaaggcaggctgctgcacctgtctgccggccagaggctgggagtgcatctgcacacagaggccagggctagacacgcctggcagctgacacagggcgctacagtgctgggcctgttcagagtgacccccgagattccagccggcctgccttctccaagaagcgaaggcggaggcggatctggcggcggaggatctagagagggacccgaactgtcccctgacgatccagccgggctgctggatctgagacagggaatgttcgcccagctggtggctcagaatgtgctgctgattgacggacctctgagctggtactccgacccagggctggcaggggtgtccctgactgggggactgtcctacaaagaagatacaaaagaactggtggtggctaaagctggggtgtactatgtgttttttcagctggaactgaggcgggtggtggctggggagggctcaggatctgtgtccctggctctgcatctgcagccactgcgctctgctgctggcgcagctgcactggctctgactgtggacctgccaccagcctctagcgaggccagaaacagcgccttcgggttccaaggacgcctgctgcatctgagcgccggacagcgcctgggagtgcatctgcatactgaagccagagcccggcatgcttggcagctgactcagggggcaactgtgctgggactgtttcgcgtgacacctgagatccctgccggactgccaagccctagatcagaa

SEQ ID NO: 178 - DNA, 1914 bp, Artificial Sequence
  DP47 Fc knob chain fused to monomeric hu 4-1BBL (71-254) DNA
gaggtgcaattgttggagtctgggggaggcttggtacagcctggggggtccctgagactctcctgtgcagcctccggattcacctttagcagttatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcagatgaacagcctgagagccgaggacacggccgtatattactgtgcgaaaggcagcggatttgactactggggccaaggaaccctggtcaccgtctcgagtgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccctgcagagatgagctgaccaagaaccaggtgtccctgtggtgtctggtcaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgagccccggcggaggcggcggaagcggaggaggaggatccagagagggccctgagctgagccccgatgatcctgctggactgctggacctgcggcagggcatgtttgctcagctggtggcccagaacgtgctgctgatcgatggccccctgtcctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgaaggatctggctctgtgtctctggccctgcatctgcagcctctgagaagcgctgctggcgctgcagctctggcactgacagtggatctgcctcctgccagctccgaggcccggaatagcgcatttgggtttcaaggcaggctgctgcacctgtctgccggccagaggctgggagtgcatctgcacacagaggccagggctagacacgcctggcagctgacacagggcgctacagtgctgggcctgttcagagtgacccccgagattccagccggcctgccttctccaagaagcgaa

SEQ ID NO: 179 - protein, 834 aa, Artificial Sequence; identical to SEQ ID NO: 123
  DP47 Fc hole chain fused to dimeric hu 4-1BBL (71-254)

SEQ ID NO: 180 - protein, 640 aa, Artificial Sequence; identical to SEQ ID NO: 124
  DP47 Fc knob chain fused to monomeric hu 4-1BBL (71-254)

SEQ ID NO: 181 - DNA, 1335 bp, Artificial Sequence
  DP47 heavy chain (hu IgG1 PGLALA) DNA
gaggtgcaattgttggagtctgggggaggcttggtacagcctggggggtccctgagactctcctgtgcagcctccggattcacctttagcagttatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcagatgaacagcctgagagccgaggacacggccgtatattactgtgcgaaaggcagcggatttgactactggggccaaggaaccctggtcaccgtctcgagtgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 182 - protein, 445 aa, Artificial Sequence
  DP47 heavy chain (hu IgG1 PGLALA)
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGSGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 183 - protein, 189 aa, Artificial Sequence
  monomeric hu 4-1BBL (71-254) plus (G4S)1 linker
REGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGS

SEQ ID NO: 184 - protein, 188 aa, Artificial Sequence
  monomeric hu 4-1BBL (71-248) plus (G4S)2 linker
REGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLGGGGSGGGGS

SEQ ID NO: 185 - protein, 183 aa, Artificial Sequence
  monomeric hu 4-1BBL (71-248) plus (G4S)1 linker
REGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLGGGGS

SEQ ID NO: 186 - DNA, 1602 bp, Artificial Sequence
  human CD19 antigen Fc knob chain avi tag DNA
cccgaggaacccctggtcgtgaaggtggaagagggcgacaatgccgtgctgcagtgcctgaagggcacctccgatggccctacccagcagctgacctggtccagagagagccccctgaagcccttcctgaagctgtctctgggcctgcctggcctgggcatccatatgaggcctctggccatctggctgttcatcttcaacgtgtcccagcagatgggcggcttctacctgtgtcagcctggccccccatctgagaaggcttggcagcctggctggaccgtgaacgtggaaggatccggcgagctgttccggtggaacgtgtccgatctgggcggcctgggatgcggcctgaagaacagatctagcgagggccccagcagccccagcggcaaactgatgagccccaagctgtacgtgtgggccaaggacagacccgagatctgggagggcgagcctccttgcctgccccctagagacagcctgaaccagagcctgagccaggacctgacaatggcccctggcagcacactgtggctgagctgtggcgtgccacccgactctgtgtctagaggccctctgagctggacccacgtgcaccctaagggccctaagagcctgctgagcctggaactgaaggacgacaggcccgccagagatatgtgggtcatggaaaccggcctgctgctgcctagagccacagcccaggatgccggcaagtactactgccacagaggcaacctgaccatgagcttccacctggaaatcaccgccagacccgtgctgtggcactggctgctgagaacaggcggctggaaggtcgacgctagcggtggtagtccgacacctccgacacccgggggtggttctgcagacaaaactcacacatgcccaccgtgcccagcacctgaagccgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggagcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggcctgaacgacatcttcgaggcccagaagattgaatggcacgag

SEQ ID NO: 187 - protein, 534 aa, Artificial Sequence
  human CD19 antigen Fc knob chain avi tag
PEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVDASGGSPTPPTPGGGSADKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGKSGGLNDIFEAQKIEWHE

SEQ ID NO: 188 - DNA, 1605 bp, Artificial Sequence
  cynomolgus CD19 antigen Fc knob chain avi tag DNA
ccccaggaacccctggtcgtgaaggtggaagagggcgacaatgccgtgctccagtgcctggaaggcacctccgatggccctacacagcagctcgtgtggtgcagagacagccccttcgagcccttcctgaacctgtctctgggcctgcctggcatgggcatcagaatgggccctctgggcatctggctgctgatcttcaacgtgtccaaccagaccggcggcttctacctgtgtcagcctggcctgccaagcgagaaggcttggcagcctggatggaccgtgtccgtggaaggatctggcgagctgttccggtggaacgtgtccgatctgggcggcctgggatgcggcctgaagaacagaagcagcgagggccctagcagccccagcggcaagctgaatagcagccagctgtacgtgtgggccaaggacagacccgagatgtgggagggcgagcctgtgtgtggcccccctagagatagcctgaaccagagcctgagccaggacctgacaatggcccctggcagcacactgtggctgagctgtggcgtgccacccgactctgtgtccagaggccctctgagctggacacacgtgcggccaaagggccctaagagcagcctgctgagcctggaactgaaggacgaccggcccgaccgggatatgtgggtggtggatacaggcctgctgctgaccagagccacagcccaggatgccggcaagtactactgccacagaggcaactggaccaagagcttttacctggaaatcaccgccagacccgccctgtggcactggctgctgagaatcggaggctggaaggtcgacgctagcggtggtagtccgacacctccgacacccgggggtggttctgcagacaaaactcacacatgcccaccgtgcccagcacctgaagccgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggagcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggcctgaacgacatcttcgaggcccagaagattgaatggcacgag

SEQ ID NO: 189 - protein, 535 aa, Artificial Sequence
  cynomolgus CD19 antigen Fc knob chain avi tag
PQEPLVVKVEEGDNAVLQCLEGTSDGPTQQLVWCRDSPFEPFLNLSLGLPGMGIRMGPLGIWLLIFNVSNQTGGFYLCQPGLPSEKAWQPGWTVSVEGSGELFRWNVSDLGGLGCGLKNRSSEGPSSPSGKLNSSQLYVWAKDRPEMWEGEPVCGPPRDSLNQSLSQDLTMAPGSTLWLSCGVPPDSVSRGPLSWTHVRPKGPKSSLLSLELKDDRPDRDMWVVDTGLLLTRATAQDAGKYYCHRGNWTKSFYLEITARPALWHWLLRIGGWKVDASGGSPTPPTPGGGSADKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGKSGGLNDIFEAQKIEWHE

SEQ ID NO: 190 - protein, 6 aa, Artificial Sequence
  humanized CD19 (8B8) HVR-L1
NSNGNT

SEQ ID NO: 191 - protein, 4 aa, Artificial Sequence
  humanized CD19 (8B8) HVR-H2
KFNG

SEQ ID NO: 192 - protein, 10 aa, Artificial Sequence
  humanized CD19 (8B8) var.1 to 9 HVR-H2
TEKFQGRVTM

SEQ ID NO: 193 - protein, 8 aa, Artificial Sequence
  humanized CD19 (8B8) var.5 HVR-L1
LENPNGNT

SEQ ID NO: 194 - protein, 8 aa, Artificial Sequence
  humanized CD19 (8B8) var.9 HVR-L1
LENPSGNT

SEQ ID NO: 195 - protein, 5 aa, Artificial Sequence
  CD19 (8B8-018) CDR-H1
DYIMH

SEQ ID NO: 196 - protein, 17 aa, Artificial Sequence
  CD19 (8B8-018) CDR-H2
YINPYNDGSKYTEKFQG

SEQ ID NO: 197 - protein, 12 aa, Artificial Sequence
  CD19 (8B8-018) CDR-H3
GTYYYGSALFDY

SEQ ID NO: 198 - protein, 16 aa, Artificial Sequence
  CD19 (8B8-018) CDR-L1
KSSQSLENPNGNTYLN

SEQ ID NO: 199 - protein, 7 aa, Artificial Sequence
  CD19 (8B8-018) CDR-L2
RVSKRFS

SEQ ID NO: 200 - protein, 9 aa, Artificial Sequence
  CD19 (8B8-018) CDR-L3
LQLTHVPYT

SEQ ID NO: 201 - protein, 121 aa, Artificial Sequence
  CD19 (8B8-018) VH
QVQLVQSGAEVKKPGASVKVSCKASGYTFTDYIMHWVRQAPGQGLEWMGYINPYNDGSKYTEKFQGRVTMTSDTSISTAYMELSRLRSDDTAVYYCARGTYYYGSALFDYWGQGTTVTVSS

SEQ ID NO: 202 - protein, 112 aa, Artificial Sequence
  CD19 (8B8-018) VL
DIVMTQTPLSLSVTPGQPASISCKSSQSLENPNGNTYLNWYLQKPGQSPQLLIYRVSKRFSGVPDRFSGSGSGTDFTLKISRVEAEDVGVYYCLQLTHVPYTFGQGTKLEIK

SEQ ID NO: 203 - DNA, 1353 bp, Artificial Sequence
  anti-CD19(8B8-018) Fc hole chain DNA
caggtccagctggtgcagtccggcgccgaggtcaagaaacccggggcttctgtgaaggtttcatgcaaggcaagcggatacaccttcaccgactatatcatgcattgggtcaggcaggcccctggccaaggtctcgaatggatgggctacattaacccatataatgatggctccaaatacaccgagaagtttcagggaagagtcactatgacatctgacaccagtatcagcactgcttacatggagctgtcccgccttcggtctgatgacaccgcagtgtattactgtgccaggggcacatattactacggctcagctctgttcgactattgggggcagggaaccacagtaaccgtgagctccgctagcaccaagggcccctccgtgttccccctggcccccagcagcaagagcaccagcggcggcacagccgctctgggctgcctggtcaaggactacttccccgagcccgtgaccgtgtcctggaacagcggagccctgacctccggcgtgcacaccttccccgccgtgctgcagagttctggcctgtatagcctgagcagcgtggtcaccgtgccttctagcagcctgggcacccagacctacatctgcaacgtgaaccacaagcccagcaacaccaaggtggacaagaaggtggagcccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 204 - DNA, 657 bp, Artificial Sequence
  anti-CD19(8B8-018) light chain DNA
gacatcgtcatgacccagacacccctgtccctctctgtgacccctggccagccagcctcaattagctgcaagtcctctcaaagtctggagaaccccaatgggaacacttaccttaattggtatctgcagaaacccggacaatcccctcaactcctgatctacagggtctctaagagattctcaggcgtgccagatcgctttagcggttccgggtctggcacagacttcaccttgaagattagtcgggttgaagctgaggatgtgggagtctattactgtctgcagctcactcatgtgccctacacctttggtcagggcacaaaactggagatcaagcggaccgtggccgctccctccgtgttcatcttcccaccctccgacgagcagctgaagtccggcaccgccagcgtggtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtccagccccgtgaccaagtccttcaaccggggcgagtgc

SEQ ID NO: 205 - protein, 451 aa, Artificial Sequence
  anti-CD19(8B8-018) Fc hole chain
QVQLVQSGAEVKKPGASVKVSCKASGYTFTDYIMHWVRQAPGQGLEWMGYINPYNDGSKYTEKFQGRVTMTSDTSISTAYMELSRLRSDDTAVYYCARGTYYYGSALFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 206 - protein, 219 aa, Artificial Sequence
  anti-CD19(8B8-018) light chain
DIVMTQTPLSLSVTPGQPASISCKSSQSLENPNGNTYLNWYLQKPGQSPQLLIYRVSKRFSGVPDRFSGSGSGTDFTLKISRVEAEDVGVYYCLQLTHVPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 207 - DNA, 2514 bp, Artificial Sequence
  anti-CD19(8B8-018) Fc hole dimeric ligand chain DNA
caggtccagctggtgcagtccggcgccgaggtcaagaaacccggggcttctgtgaaggtttcatgcaaggcaagcggatacaccttcaccgactatatcatgcattgggtcaggcaggcccctggccaaggtctcgaatggatgggctacattaacccatataatgatggctccaaatacaccgagaagtttcagggaagagtcactatgacatctgacaccagtatcagcactgcttacatggagctgtcccgccttcggtctgatgacaccgcagtgtattactgtgccaggggcacatattactacggctcagctctgttcgactattgggggcagggaaccacagtaaccgtgagctccgctagcaccaagggcccctccgtgttccccctggcccccagcagcaagagcaccagcggcggcacagccgctctgggctgcctggtcaaggactacttccccgagcccgtgaccgtgtcctggaacagcggagccctgacctccggcgtgcacaccttccccgccgtgctgcagagttctggcctgtatagcctgagcagcgtggtcaccgtgccttctagcagcctgggcacccagacctacatctgcaacgtgaaccacaagcccagcaacaccaaggtggacaagaaggtggagcccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtggaggcggcggaagcggaggaggaggatccagagagggccctgagctgagccccgatgatcctgctggactgctggacctgcggcagggcatgtttgctcagctggtggcccagaacgtgctgctgatcgatggccccctgtcctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgaaggatctggctctgtgtctctggccctgcatctgcagcctctgagaagcgctgctggcgctgcagctctggcactgacagtggatctgcctcctgccagctccgaggcccggaatagcgcatttgggtttcaaggcaggctgctgcacctgtctgccggccagaggctgggagtgcatctgcacacagaggccagggctagacacgcctggcagctgacacagggcgctacagtgctgggcctgttcagagtgacccccgagattccagccggcctgccttctccaagaagcgaaggcggaggcggatctggcggcggaggatctagagagggacccgaactgtcccctgacgatccagccgggctgctggatctgagacagggaatgttcgcccagctggtggctcagaatgtgctgctgattgacggacctctgagctggtactccgacccagggctggcaggggtgtccctgactgggggactgtcctacaaagaagatacaaaagaactggtggtggctaaagctggggtgtactatgtgttttttcagctggaactgaggcgggtggtggctggggagggctcaggatctgtgtccctggctctgcatctgcagccactgcgctctgctgctggcgcagctgcactggctctgactgtggacctgccaccagcctctagcgaggccagaaacagcgccttcgggttccaaggacgcctgctgcatctgagcgccggacagcgcctgggagtgcatctgcatactgaagccagagcccggcatgcttggcagctgactcagggggcaactgtgctgggactgtttcgcgtgacacctgagatccctgccggactgccaagccctagatcagaa

SEQ ID NO: 208 - DNA, 1932 bp, Artificial Sequence
  anti-CD19(8B8-018) Fc knob monomeric ligand DNA
caggtccagctggtgcagtccggcgccgaggtcaagaaacccggggcttctgtgaaggtttcatgcaaggcaagcggatacaccttcaccgactatatcatgcattgggtcaggcaggcccctggccaaggtctcgaatggatgggctacattaacccatataatgatggctccaaatacaccgagaagtttcagggaagagtcactatgacatctgacaccagtatcagcactgcttacatggagctgtcccgccttcggtctgatgacaccgcagtgtattactgtgccaggggcacatattactacggctcagctctgttcgactattgggggcagggaaccacagtaaccgtgagctccgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccctgcagagatgagctgaccaagaaccaggtgtccctgtggtgtctggtcaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgagccccggcggaggcggcggaagcggaggaggaggatccagagagggccctgagctgagccccgatgatcctgctggactgctggacctgcggcagggcatgtttgctcagctggtggcccagaacgtgctgctgatcgatggccccctgtcctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgaaggatctggctctgtgtctctggccctgcatctgcagcctctgagaagcgctgctggcgctgcagctctggcactgacagtggatctgcctcctgccagctccgaggcccggaatagcgcatttgggtttcaaggcaggctgctgcacctgtctgccggccagaggctgggagtgcatctgcacacagaggccagggctagacacgcctggcagctgacacagggcgctacagtgctgggcctgttcagagtgacccccgagattccagccggcctgccttctccaagaagcgaa

SEQ ID NO: 209 - protein, 838 aa, Artificial Sequence
  anti-CD19(8B8-018) Fc hole dimeric ligand chain
QVQLVQSGAEVKKPGASVKVSCKASGYTFTDYIMHWVRQAPGQGLEWMGYINPYNDGSKYTEKFQGRVTMTSDTSISTAYMELSRLRSDDTAVYYCARGTYYYGSALFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 210 - protein, 644 aa, Artificial Sequence
  anti-CD19(8B8-018) Fc knob monomeric ligand
QVQLVQSGAEVKKPGASVKVSCKASGYTFTDYIMHWVRQAPGQGLEWMGYINPYNDGSKYTEKFQGRVTMTSDTSISTAYMELSRLRSDDTAVYYCARGTYYYGSALFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 211 - DNA, 2478 bp, Artificial Sequence
  anti-CD19(8B8-018) Fc hole dimeric ligand (71-248) chain DNA
caggtccagctggtgcagtccggcgccgaggtcaagaaacccggggcttctgtgaaggtttcatgcaaggcaagcggatacaccttcaccgactatatcatgcattgggtcaggcaggcccctggccaaggtctcgaatggatgggctacattaacccatataatgatggctccaaatacaccgagaagtttcagggaagagtcactatgacatctgacaccagtatcagcactgcttacatggagctgtcccgccttcggtctgatgacaccgcagtgtattactgtgccaggggcacatattactacggctcagctctgttcgactattgggggcagggaaccacagtaaccgtgagctccgctagcaccaagggcccctccgtgttccccctggcccccagcagcaagagcaccagcggcggcacagccgctctgggctgcctggtcaaggactacttccccgagcccgtgaccgtgtcctggaacagcggagccctgacctccggcgtgcacaccttccccgccgtgctgcagagttctggcctgtatagcctgagcagcgtggtcaccgtgccttctagcagcctgggcacccagacctacatctgcaacgtgaaccacaagcccagcaacaccaaggtggacaagaaggtggagcccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtggaggcggcggaagcggaggaggaggatccagagagggccctgagctgagccctgatgatcctgccggactgctggacctgcggcagggaatgtttgcccagctggtggcccagaacgtgctgctgatcgatggccccctgtcctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgaaggatctggctctgtgtctctggccctgcatctgcagcctctgagatctgctgctggcgccgctgctctggcactgacagtggatctgcctcctgccagcagcgaggcccggaatagcgcatttgggtttcaaggcaggctgctgcacctgtctgccggccagaggctgggagtgcatctgcacacagaggccagggctagacacgcctggcagctgacacagggcgctacagtgctgggcctgttcagagtgacccccgagattccagcaggcctgggaggcggcggatctggcggcggaggatctagagaaggacccgagctgtcccccgacgatcccgctgggctgctggatctgagacagggcatgttcgctcagctggtggctcagaatgtgctgctgattgacggacctctgagctggtactccgacccagggctggcaggggtgtccctgactgggggactgtcctacaaagaagatacaaaagaactggtggtggctaaagctggggtgtactatgtgttttttcagctggaactgaggcgggtggtggctggggagggctcaggatctgtgtccctggctctgcatctgcagccactgcgctctgcagcaggggctgcagcactggccctgactgtggacctgcccccagcttcttccgaggccagaaacagcgccttcgggttccaaggacgcctgctgcatctgagcgccggacagcgcctgggagtgcatctgcatactgaagccagagcccggcatgcttggcagctgactcagggggcaactgtgctgggactgtttcgcgtgacacctgagatcccagccgggctc

SEQ ID NO: 212 - DNA, 1914 bp, Artificial Sequence
  anti-CD19(8B8-018) Fc knob monomeric (71-248) ligand DNA
caggtccagctggtgcagtccggcgccgaggtcaagaaacccggggcttctgtgaaggtttcatgcaaggcaagcggatacaccttcaccgactatatcatgcattgggtcaggcaggcccctggccaaggtctcgaatggatgggctacattaacccatataatgatggctccaaatacaccgagaagtttcagggaagagtcactatgacatctgacaccagtatcagcactgcttacatggagctgtcccgccttcggtctgatgacaccgcagtgtattactgtgccaggggcacatattactacggctcagctctgttcgactattgggggcagggaaccacagtaaccgtgagctccgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccctgcagagatgagctgaccaagaaccaggtgtccctgtggtgtctggtcaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgagccccggcggaggcggcggaagcggaggaggaggatccagagagggccctgagctgagccctgatgatcctgccggactgctggacctgcggcagggaatgtttgcccagctggtggcccagaacgtgctgctgatcgatggccccctgtcctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgaaggatctggctctgtgtctctggccctgcatctgcagcctctgagatctgctgctggcgccgctgctctggcactgacagtggatctgcctcctgccagcagcgaggcccggaatagcgcatttgggtttcaaggcaggctgctgcacctgtctgccggccagaggctgggagtgcatctgcacacagaggccagggctagacacgcctggcagctgacacagggcgctacagtgctgggcctgttcagagtgacccccgagattcctgccgggctc

SEQ ID NO: 213 - protein, 826 aa, Artificial Sequence
  anti-CD19(8B8-018) Fc hole dimeric ligand (71-248) chain
QVQLVQSGAEVKKPGASVKVSCKASGYTFTDYIMHWVRQAPGQGLEWMGYINPYNDGSKYTEKFQGRVTMTSDTSISTAYMELSRLRSDDTAVYYCARGTYYYGSALFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGL

SEQ ID NO: 214 - protein, 638 aa, Artificial Sequence
  anti-CD19(8B8-018) Fc knob monomeric (71-248) ligand
QVQLVQSGAEVKKPGASVKVSCKASGYTFTDYIMHWVRQAPGQGLEWMGYINPYNDGSKYTEKFQGRVTMTSDTSISTAYMELSRLRSDDTAVYYCARGTYYYGSALFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGL

SEQ ID NO: 215 - DNA, 363 bp, Artificial Sequence
  Nucleotide sequence CD19 (8B8) VH Parental clone DNA
gaggtccagctgcagcagtctggacctgagctggtaaagcctggggcttcagtgaagatggcctgcaaggcttctggatacacattcactgactatattatgcactgggtgaagcagaagactgggcagggccttgagtggattggatatattaatccttacaatgatggttctaagtacactgagaagttcaacggcaaggccacactgacttcagacaaatcttccatcacagcctacatggagctcagcagcctgacctctgaggactctgcggtctattactgtgcaagagggacctattattatggtagcgccctctttgactactggggccaaggcaccactctcacagtctcctcg

SEQ ID NO: 216 - DNA, 336 bp, Artificial Sequence
  Nucleotide sequence CD19 (8B8) VL Parental clone DNA
gatgctgtgatgacccaaactccactctccctgcctgtcagtcttggagatcaagcctccatctcttgcaggtctagtcagagccttgaaaacagtaatggaaacacctatttgaactggtacctccagaaaccaggccagtctccacaactcctgatctacagggtttccaaacgattttctggggtcctagacaggttcagtggtagtggatcagggacagatttcacactgaaaatcagcagagtggaggctgaggatttgggagtttatttctgcctacaacttacacatgtcccgtacacgttcggaggggggaccaagctggaaataaaa

SEQ ID NO: 217 - DNA, 94 bp, Artificial Sequence
  43-45: 40% Y, 6% A/S/T/G/P/D/N/E/Q/V, 49-51: 40% N, 6% A/S/T/Y/G/P/D/E/Q/V, 55-57: 25% S/T/Q/E, 61-63: 25% S/T/Q/E
  misc_feature (43)..(45): n is a, c, g or t
  misc_feature (49)..(51): n is a, c, g or t
  misc_feature (55)..(57): n is a, c, g or t
  misc_feature (61)..(63): n is a, c, g or t
cagctgcgggctctgacccggtttctggagataccagttcagnnncgtnnngccnnnggannnttccagagattggctggatttgcaagaaatg

SEQ ID NO: 218 - DNA, 99 bp, Artificial Sequence
  40-42: 30% R, 20% E, 5% A/S/T/Y/G/P/D/N/Q/V. 49-51: 30% K, 20% S, 5% A/N/T/Y/G/P/D/E/Q/V, 55-57: 40% F, 5% A/S/T/Y/G/P/D/E/Q/V/I/L, 58-60: 40% S, 6.6% A/T/Y/G/P/D/E/Q/V, 67-69: 50% P, 50% L
  misc_feature (40)..(42): n is a, c, g or t
  misc_feature (49)..(51): n is a, c, g or t
  misc_feature (55)..(57): n is a, c, g or t
  misc_feature (58)..(60): n is a, c, g or t
  misc_feature (67)..(69): n is a, c, g or t
ctccagaaaccgggtcagagcccgcagctgctgatctacnnngtatctnnncgcnnnnnnggcgttnnngatcgtttcagcggttctggatccggcacc

SEQ ID NO: 219 - DNA, 99 bp, Artificial Sequence
  40-42: 52% H, 4% G/A/S/P/T/N/Y/D/E/Q/V/I, 46-48: 30% I, 15% Y, 5% G/A/S/T/P/N/H/D/E/Q/V, 49-51: 52% Y, 4% G/A/S/P/T/N/H/D/E/Q/V/I, 52-54: 30% D, 15% G, 5% A/S/P/Y/N/H/D/E/Q/V/I, 55-57: 52% T, 4% G/A/S/P/Y/N/H/D/E/Q/V/I, 61-63: 52% T, 4% G/A/S/P/Y/N/H/D/E/Q/V/I
  misc_feature (40)..(42): n is a, c, g or t
  misc_feature (46)..(48): n is a, c, g or t
  misc_feature (49)..(51): n is a, c, g or t
  misc_feature (52)..(54): n is a, c, g or t
  misc_feature (55)..(57): n is a, c, g or t
  misc_feature (61)..(63): n is a, c, g or t
catccactccagaccctggcccggggcctgacgaacccannncatnnnnnnnnnnnngaannngtaaccagatgctttgcagctcactttaacggaagc

SEQ ID NO: 220 - DNA, 99 bp, Artificial Sequence
  34-36: 45% Y, 5% others, 40-42: 52% N, 4% others, 46-48: 40% Y, 5% others, 49-51: 30% N, 15% S, 5% others, 52-54: 30% D, 15% G, 5% others,  55-57: 52% G, 4% others, 61-63: 30% K, 15% N, 4% others, 70-72: 30% E, 15% Q, 5% others
  misc_feature (34)..(36): n is a, c, g or t
  misc_feature (40)..(42): n is a, c, g or t
  misc_feature (46)..(48): n is a, c, g or t
  misc_feature (49)..(51): n is a, c, g or t
  misc_feature (52)..(54): n is a, c, g or t
  misc_feature (55)..(57): n is a, c, g or t
  misc_feature (61)..(63): n is a, c, g or t
  misc_feature (70)..(72): n is a, c, g or t
caggccccgggccagggtctggagtggatgggcnnnattnnnccannnnnnnnnnnntccnnntataccnnnaaattccagggccgcgtcacgatgacc

SEQ ID NO: 221 - DNA, 33 bp, Artificial Sequence
  CD19 H3 reverse constant
cgtcaccggttcggggaagtagtccttgaccag

SEQ ID NO: 222 - DNA, 26 bp, Artificial Sequence
  LMB3
caggaaacagctatgaccatgattac

SEQ ID NO: 223 - DNA, 33 bp, Artificial Sequence
  CD19 L1 forward constant
tggtatctccagaaaccgggtcagagcccgcag

SEQ ID NO: 224 - DNA, 84 bp, Artificial Sequence
  34-36: 52% Y, 4% others, 37-39: 52% P, 4% others, 40-42: 42% V, 10% L, 4% others, 43-45: 52% H, 4% others, 46-48: 42% T, 10% I, 4% others, 49-51: 45% L, 11% G, 4% others
  misc_feature (34)..(36): n is a, c, g or t
  misc_feature (37)..(39): n is a, c, g or t
  misc_feature (40)..(42): n is a, c, g or t
  misc_feature (43)..(45): n is a, c, g or t
  misc_feature (46)..(48): n is a, c, g or t
  misc_feature (49)..(51): n is a, c, g or t
tttaatttccagtttagttccttgaccgaaggtnnnnnnnnnnnnnnnnnnctgcagacaatagtagacgccaacgtcttcagc

SEQ ID NO: 225 - DNA, 35 bp, Artificial Sequence
  CD19 L3 forward constant
accttcggtcaaggaactaaactggaaattaaacg

SEQ ID NO: 226 - DNA, 107 bp, Artificial Sequence
  pos. 59-61: 50% L, 3.8% others, 62-64: 50% A, 4.2% others, 65-67: 50% S, 4.2% others, 68-70: 50% G, 4.2% others, 71-73: 50% Y, 4.2% others, 74-76: 50% Y, 4.2% others, 77-79: 50% Y, 4.2% others, 80-82: 50% T, 4.2% others, 83-85: 50% G, 4.2% others.
  misc_feature (54)..(58): n is a, c, g, or t
  misc_feature (59)..(61): n is a, c, g or t
  misc_feature (62)..(64): n is a, c, g or t
  misc_feature (65)..(67): n is a, c, g or t
  misc_feature (68)..(70): n is a, c, g or t
  misc_feature (71)..(73): n is a, c, g or t
  misc_feature (74)..(76): n is a, c, g or t
  misc_feature (77)..(79): n is a, c, g or t
  misc_feature (80)..(82): n is a, c, g or t
  misc_feature (83)..(85): n is a, c, g or t
ttggtgctagcagagcttacggtcaccgtggtaccttggccccagtaatcaaannnnnnnnnnnnnnnnnnnnnnnnnnngcgtgcacaatagtaaacagcggtgtc

SEQ ID NO: 227 - DNA, 1615 bp, Artificial Sequence
  SNAP tag human  CD19 ECD- PDGFR DNA
ggccgccgctagcggcatcgactacaaggacgacgatgacaaggccggcatcgatgccatcatggacaaagactgcgaaatgaagcgcaccaccctggatagccctctgggcaagctggaactgtctgggtgcgaacagggcctgcacgagatcaagctgctgggcaaaggaacatctgccgccgacgccgtggaagtgcctgccccagccgccgtgctgggcggaccagagccactgatgcaggccaccgcctggctcaacgcctactttcaccagcctgaggccatcgaggagttccctgtgccagccctgcaccacccagtgttccagcaggagagctttacccgccaggtgctgtggaaactgctgaaagtggtgaagttcggagaggtcatcagctaccagcagctggccgccctggccggcaatcccgccgccaccgccgccgtgaaaaccgccctgagcggaaatcccgtgcccattctgatcccctgccaccgggtggtgtctagctctggcgccgtggggggctacgagggcgggctcgccgtgaaagagtggctgctggcccacgagggccacagactgggcaagcctgggctgggtgatatccccgaggaacccctggtcgtgaaggtggaagagggcgacaatgccgtgctgcagtgcctgaagggcacctccgatggccctacccagcagctgacctggtccagagagagccccctgaagcccttcctgaagctgtctctgggcctgcctggcctgggcatccatatgaggcctctggccatctggctgttcatcttcaacgtgtcccagcagatgggcggcttctacctgtgtcagcctggccccccatctgagaaggcttggcagcctggctggaccgtgaacgtggaaggatccggcgagctgttccggtggaacgtgtccgatctgggcggcctgggatgcggcctgaagaacagatctagcgagggccccagcagccccagcggcaaactgatgagccccaagctgtacgtgtgggccaaggacagacccgagatctgggagggcgagcctccttgcctgccccctagagacagcctgaaccagagcctgagccaggacctgacaatggcccctggcagcacactgtggctgagctgtggcgtgccacccgactctgtgtctagaggccctctgagctggacccacgtgcaccctaagggccctaagagcctgctgagcctggaactgaaggacgacaggcccgccagagatatgtgggtcatggaaaccggcctgctgctgcctagagccacagcccaggatgccggcaagtactactgccacagaggcaacctgaccatgagcttccacctggaaatcaccgccagacccgtgctgtggcactggctgctgagaacaggcggctggaaggtcgacgaacaaaaactcatctcagaagaggatctgaatgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgt

SEQ ID NO: 228 - DNA, 1620 bp, Artificial Sequence
  SNAP tag cynomolgus  CD19 ECD- PDGFR DNA
ccggccgccgctagcggcatcgactacaaggacgacgatgacaaggccggcatcgatgccatcatggacaaagactgcgaaatgaagcgcaccaccctggatagccctctgggcaagctggaactgtctgggtgcgaacagggcctgcacgagatcaagctgctgggcaaaggaacatctgccgccgacgccgtggaagtgcctgccccagccgccgtgctgggcggaccagagccactgatgcaggccaccgcctggctcaacgcctactttcaccagcctgaggccatcgaggagttccctgtgccagccctgcaccacccagtgttccagcaggagagctttacccgccaggtgctgtggaaactgctgaaagtggtgaagttcggagaggtcatcagctaccagcagctggccgccctggccggcaatcccgccgccaccgccgccgtgaaaaccgccctgagcggaaatcccgtgcccattctgatcccctgccaccgggtggtgtctagctctggcgccgtggggggctacgagggcgggctcgccgtgaaagagtggctgctggcccacgagggccacagactgggcaagcctgggctgggtgatatcccccaggaacccctggtcgtgaaggtggaagagggcgacaatgccgtgctccagtgtctcgagggcacctccgatggccctacacagcagctcgtgtggtgcagagacagccccttcgagcccttcctgaacctgtctctgggcctgcctggcatgggcatcagaatgggccctctgggcatctggctgctgatcttcaacgtgtccaaccagaccggcggcttctacctgtgtcagcctggcctgccaagcgagaaggcttggcagcctggatggaccgtgtccgtggaaggatctggcgagctgttccggtggaacgtgtccgatctgggcggcctgggatgcggcctgaagaacagaagcagcgagggccctagcagccccagcggcaagctgaatagcagccagctgtacgtgtgggccaaggacagacccgagatgtgggagggcgagcctgtgtgtggcccccctagagatagcctgaaccagagcctgagccaggacctgacaatggcccctggcagcacactgtggctgagctgtggcgtgccacccgactctgtgtccagaggccctctgagctggacacacgtgcggcctaagggccctaagagcagcctgctgagcctggaactgaaggacgaccggcccgaccgggatatgtgggtggtggatacaggcctgctgctgaccagagccacagcccaggatgccggcaagtactactgccacagaggcaactggaccaagagcttttacctggaaatcaccgccagacccgccctgtggcactggctgctgagaatcggaggctggaaggtcgacgagcagaagctgatctccgaagaggacctgaacgccgtgggccaggatacccaggaagtgatcgtggtgccccacagcctgcccttcaaggtggtcgtgatcagcgccattctggccctggtggtgctgaccatcatcagcctgatcatcctgattatgctgtggcagaaaaagccccgc

SEQ ID NO: 229 - protein, 539 aa, Artificial Sequence
  SNAP tag human  CD19 ECD- PDGFR
PAAASGIDYKDDDDKAGIDAIMDKDCEMKRTTLDSPLGKLELSGCEQGLHEIKLLGKGTSAADAVEVPAPAAVLGGPEPLMQATAWLNAYFHQPEAIEEFPVPALHHPVFQQESFTRQVLWKLLKVVKFGEVISYQQLAALAGNPAATAAVKTALSGNPVPILIPCHRVVSSSGAVGGYEGGLAVKEWLLAHEGHRLGKPGLGDIPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVDEQKLISEEDLNAVGQDTQEVIVVPHSLPFKVVVISAILALVVLTIISLIILIMLWQKKPR

SEQ ID NO: 230 - protein, 540 aa, Artificial Sequence
  SNAP tag cynomolgus  CD19 ECD- PDGFR
PAAASGIDYKDDDDKAGIDAIMDKDCEMKRTTLDSPLGKLELSGCEQGLHEIKLLGKGTSAADAVEVPAPAAVLGGPEPLMQATAWLNAYFHQPEAIEEFPVPALHHPVFQQESFTRQVLWKLLKVVKFGEVISYQQLAALAGNPAATAAVKTALSGNPVPILIPCHRVVSSSGAVGGYEGGLAVKEWLLAHEGHRLGKPGLGDIPQEPLVVKVEEGDNAVLQCLEGTSDGPTQQLVWCRDSPFEPFLNLSLGLPGMGIRMGPLGIWLLIFNVSNQTGGFYLCQPGLPSEKAWQPGWTVSVEGSGELFRWNVSDLGGLGCGLKNRSSEGPSSPSGKLNSSQLYVWAKDRPEMWEGEPVCGPPRDSLNQSLSQDLTMAPGSTLWLSCGVPPDSVSRGPLSWTHVRPKGPKSSLLSLELKDDRPDRDMWVVDTGLLLTRATAQDAGKYYCHRGNWTKSFYLEITARPALWHWLLRIGGWKVDEQKLISEEDLNAVGQDTQEVIVVPHSLPFKVVVISAILALVVLTIISLIILIMLWQKKPR

SEQ ID NO: 231 - protein, 16 aa, Artificial Sequence
  CD19 (8B8-5H09) CDR-L1
KSSQSLESSTGNTYLN

SEQ ID NO: 232 - protein, 7 aa, Artificial Sequence
  CD19(8B8-5H09) CDR-L2
RVSKRFS

SEQ ID NO: 233 - protein, 9 aa, Artificial Sequence
  CD19(8B8-5H09) CDR-L3
LQLIDYPVT

SEQ ID NO: 234 - protein, 5 aa, Artificial Sequence
  CD19(8B8-5H09) CDR-H1
DYIMH

SEQ ID NO: 235 - protein, 17 aa, Artificial Sequence
  CD19(8B8-5H09) CDR-H2
YINPYNDGSKYTEKFQG

SEQ ID NO: 236 - protein, 12 aa, Artificial Sequence
  CDR(8B8-5H09) CDR-H3
GTYYYGSALFDY

SEQ ID NO: 237 - protein, 16 aa, Artificial Sequence
  CD19(8B8-7H07) CDR-L1
KSSQSLETSTGNTYLN

SEQ ID NO: 238 - protein, 7 aa, Artificial Sequence
  CD19 (8B8-7H07) CDR-L2
RVSKRFS

SEQ ID NO: 239 - protein, 9 aa, Artificial Sequence
  CD19 (8B8-7H07) CDR-L3
LQATHIPYT

SEQ ID NO: 240 - protein, 5 aa, Artificial Sequence
  CD19 (8B8-7H07) CDR-H1
DYIMH

SEQ ID NO: 241 - protein, 17 aa, Artificial Sequence
  CD19 (8B8-7H07) CDR-H2
YINPYNDGSKYTEKFQG

SEQ ID NO: 242 - protein, 12 aa, Artificial Sequence
  CD19 (8B8-7H07) CDR-H3
GTYYYGSELFDY

SEQ ID NO: 243 - protein, 16 aa, Artificial Sequence
  CD19 (8B8-2B03) CDR-L1
KSSQSLETSTGNTYLN

SEQ ID NO: 244 - protein, 7 aa, Artificial Sequence
  CD19 (8B8-2B03) CDR-L2
RVSKRFS

SEQ ID NO: 245 - protein, 9 aa, Artificial Sequence
  CD19 (8B8-2B03) CDR-L3
LQLTHVPYT

SEQ ID NO: 246 - protein, 5 aa, Artificial Sequence
  CD19 (8B8-2B03) CDR-H1
DYITH

SEQ ID NO: 247 - protein, 17 aa, Artificial Sequence
  CD19 (8B8-2B03) CDR-H2
YINPYNDGSKYTEKFQG

SEQ ID NO: 248 - protein, 12 aa, Artificial Sequence
  CD19 (8B8-2B03) CDR-H3
GTYYYGPDLFDY

SEQ ID NO: 249 - protein, 16 aa, Artificial Sequence
  CD19 (8B8-2B11) CDR-L1
KSSQSLETSTGTTYLN

SEQ ID NO: 250 - protein, 7 aa, Artificial Sequence
  CD19 (8B8-2B11) CDR-L2
RVSKRFS

SEQ ID NO: 251 - protein, 9 aa, Artificial Sequence
  CD19 (8B8-2B11) CDR-L3
LQLLEDPYT

SEQ ID NO: 252 - protein, 5 aa, Artificial Sequence
  CD19 (8B8-2B11) CDR-H1
DYIMH

SEQ ID NO: 253 - protein, 17 aa, Artificial Sequence
  CD19 (8B8-2B11) CDR-H2
YINPYNDGSKYTEKFQG

SEQ ID NO: 254 - protein, 12 aa, Artificial Sequence
  CD19 (8B8-2B11) CDR-H3
GTYYYGPQLFDY

SEQ ID NO: 255 - protein, 16 aa, Artificial Sequence
  CD19 (8B8-5A07) CDR-L1
KSSQSLETSTGNTYLN

SEQ ID NO: 256 - protein, 7 aa, Artificial Sequence
  CD19 (8B8-5A07) CDR-L2
RVSKRFS

SEQ ID NO: 257 - protein, 9 aa, Artificial Sequence
  CD19 (8B8-5A07) CDR-L3
LQPGHYPGT

SEQ ID NO: 258 - protein, 5 aa, Artificial Sequence
  CD19 (8B8-5A07) CDR-H1
DYIMH

SEQ ID NO: 259 - protein, 17 aa, Artificial Sequence
  CD19 (8B8-5A07) CDR-H2
YINPYNDGSKYTEKFQG

SEQ ID NO: 260 - protein, 12 aa, Artificial Sequence
  CD19 (8B8-5A07) CDR-H3
GTYYYGSALFDY

SEQ ID NO: 261 - protein, 16 aa, Artificial Sequence
  CD19 (8B8-5B08) CDR-L1
KSSQSLETSTGNTYLN

SEQ ID NO: 262 - protein, 7 aa, Artificial Sequence
  CD19 (8B8-5B08) CDR-L2
RVSKRFS

SEQ ID NO: 263 - protein, 9 aa, Artificial Sequence
  CD19 (8B8-5B08) CDR-L3
LQLDSYPNT

SEQ ID NO: 264 - protein, 5 aa, Artificial Sequence
  CD19 (8B8-5B08) CDR-H1
DYIMH

SEQ ID NO: 265 - protein, 17 aa, Artificial Sequence
  CD19 (8B8-5B08) CDR-H2
YINPYNDGSKYTEKFQG

SEQ ID NO: 266 - protein, 12 aa, Artificial Sequence
  CD19 (8B8-5B08) CDR-H3
GTYYYGPQLFDY

SEQ ID NO: 267 - protein, 16 aa, Artificial Sequence
  CD19 (8B8-5D08) CDR-L1
KSSQSLETSTGNTYLN

SEQ ID NO: 268 - protein, 7 aa, Artificial Sequence
  CD19 (8B8-5D08) CDR-L2
RVSKRFS

SEQ ID NO: 269 - protein, 9 aa, Artificial Sequence
  CD19 (8B8-5D08) CDR-L3
LQLTHEPYT

SEQ ID NO: 270 - protein, 5 aa, Artificial Sequence
  CD19 (8B8-5D08) CDR-H1
DYIMH

SEQ ID NO: 271 - protein, 17 aa, Artificial Sequence
  CD19 (8B8-5D08) CDR-H2
YINPYNDGSKYTEKFQG

SEQ ID NO: 272 - protein, 12 aa, Artificial Sequence
  CD19 (8B8-5D08) CDR-H3
GTYYYGSELFDY

SEQ ID NO: 273 - DNA, 657 bp, Artificial Sequence
  CD19 (8B8) parental light chain DNA
gatgctgtgatgacccaaactccactctccctgcctgtcagtcttggagatcaagcctccatctcttgcaggtctagtcagagccttgaaaacagtaatggaaacacctatttgaactggtacctccagaaaccaggccagtctccacaactcctgatctacagggtttccaaacgattttctggggtcctagacaggttcagtggtagtggatcagggacagatttcacactgaaaatcagcagagtggaggctgaggatttgggagtttatttctgcctacaacttacacatgtcccgtacacgttcggaggggggaccaagctggaaataaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 274 - DNA, 1353 bp, Artificial Sequence
  CD19 (8B8)  parental heavy chain DNA
gaggtccagctgcagcagtctggacctgagctggtaaagcctggggcttcagtgaagatggcctgcaaggcttctggatacacattcactgactatattatgcactgggtgaagcagaagactgggcagggccttgagtggattggatatattaatccttacaatgatggttctaagtacactgagaagttcaacggcaaggccacactgacttcagacaaatcttccatcacagcctacatggagctcagcagcctgacctctgaggactctgcggtctattactgtgcaagagggacctattattatggtagcgccctctttgactactggggccaaggcaccactctcacagtctcctcggctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 275 - protein, 219 aa, Artificial Sequence
  CD19 (8B8) parental light chain
DAVMTQTPLSLPVSLGDQASISCRSSQSLENSNGNTYLNWYLQKPGQSPQLLIYRVSKRFSGVLDRFSGSGSGTDFTLKISRVEAEDLGVYFCLQLTHVPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 276 - protein, 451 aa, Artificial Sequence
  CD19 (8B8)  parental heavy chain
EVQLQQSGPELVKPGASVKMACKASGYTFTDYIMHWVKQKTGQGLEWIGYINPYNDGSKYTEKFNGKATLTSDKSSITAYMELSSLTSEDSAVYYCARGTYYYGSALFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 277 - DNA, 657 bp, Artificial Sequence
  CD19 (8B8-2B11) light chain DNA
gatattgtcatgactcaaactccactgtctctgtccgtgaccccgggtcagccagcgagcatttcttgcaaatccagccaatctctggaaacctccaccggcaccacgtacctgaactggtatctccagaaaccgggtcagagcccgcagctgctgatctaccgtgtatctaagcgcttctccggcgttcctgatcgtttcagcggttctggatccggcaccgactttactctgaaaatcagccgtgtggaagctgaagacgttggcgtctactattgtctgcagctgctggaagatccatacaccttcggtcaaggaacgaaactggaaattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 278 - DNA, 1353 bp, Artificial Sequence
  CD19 (8B8-2B11)  heavy chain DNA
caggtgcaattggttcaatctggtgctgaagtaaaaaaaccgggcgcttccgttaaagtgagctgcaaagcatctggttacaccttcactgactatatcatgcactgggttcgtcaggccccgggccagggtctggagtggatgggctacattaacccatacaacgacggttccaaatataccgagaaattccagggccgcgtcacgatgaccagcgacacttctatctccaccgcgtacatggaactgtctagactgcgttctgacgacaccgctgtttactattgtgcacgcggtacctactactacggtccacagctgtttgattactggggccaaggtaccacggtgaccgtaagctctgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 279 - protein, 219 aa, Artificial Sequence
  CD19 (8B8-2B11)  light chain
DIVMTQTPLSLSVTPGQPASISCKSSQSLETSTGTTYLNWYLQKPGQSPQLLIYRVSKRFSGVPDRFSGSGSGTDFTLKISRVEAEDVGVYYCLQLLEDPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 280 - protein, 451 aa, Artificial Sequence
  CD19 (8B8-2B11) heavy chain
QVQLVQSGAEVKKPGASVKVSCKASGYTFTDYIMHWVRQAPGQGLEWMGYINPYNDGSKYTEKFQGRVTMTSDTSISTAYMELSRLRSDDTAVYYCARGTYYYGPQLFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 281 - DNA, 657 bp, Artificial Sequence
  CD19 (8B8-7H07)  light chain DNA
gatattgttatgactcaaactccactgtctctgtccgtgaccccgggtcagccagcgagcatttcttgcaaatccagccaatctctggaaacctccaccggcaacacgtacctgaactggtatctccagaaaccgggtcagagcccgcagctgctgatctaccgtgtatctaagcgcttctccggcgttcctgatcgtttcagcggttctggatccggcaccgactttactctgaaaatcagccgtgtggaagctgaagacgttggcgtctactattgtctgcaggcaacccatatcccatacaccttcggtcaaggaactaaactggaaattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 282 - DNA, 1353 bp, Artificial Sequence
  CD19 (8B8-7H07)  heavy chain DNA
caggtgcaattggttcaatctggtgctgaagtaaaaaaaccgggcgcttccgttaaagtgagctgcaaagcatctggttacaccttcactgactatatcatgcactgggttcgtcaggccccgggccagggtctggagtggatgggctacattaacccatacaacgacggttccaaatataccgagaaattccagggccgcgtcacgatgaccagcgacacttctatctccaccgcgtacatggaactgtctagactgcgttctgacgacaccgctgtttactattgtgcacgcggtacctactactacggttctgaactgtttgattactggggccaaggtaccacggtgaccgtaagctctgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 283 - protein, 219 aa, Artificial Sequence
  CD19 (8B8-7H07)  light chain
DIVMTQTPLSLSVTPGQPASISCKSSQSLETSTGNTYLNWYLQKPGQSPQLLIYRVSKRFSGVPDRFSGSGSGTDFTLKISRVEAEDVGVYYCLQATHIPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 284 - protein, 451 aa, Artificial Sequence
  CD19 (8B8-7H07) heavy chain
QVQLVQSGAEVKKPGASVKVSCKASGYTFTDYIMHWVRQAPGQGLEWMGYINPYNDGSKYTEKFQGRVTMTSDTSISTAYMELSRLRSDDTAVYYCARGTYYYGSELFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 285 - DNA, 657 bp, Artificial Sequence
  CD19 (8B8-2B03) light chain DNA
  misc_feature (320)..(321): n is a, c, g, or t
gatattgttatgactcaaactccactgtctctgtccgtgaccccgggtcagccagcgagcatttcttgcaaatccagccaatctctggaaacctccaccggcaacacgtacctgaactggtatctccagaaaccgggtcagagcccgcagctgctgatctaccgtgtatctaagcgcttctccggcgttcctgatcgtttcagcggttctggatccggcaccgactttactctgaaaatcagccgtgtggaagctgaagacgttggcgtctactattgtctgcagttgacccacgttccgtacaccttcggtcaaggaannaaactggaaattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 286 - DNA, 1353 bp, Artificial Sequence
  CD19 (8B8-2B03)  heavy chain DNA
caggtgcaattggttcaatctggtgctgaagtaaaaaaaccgggcgcttccgttaaagtgagctgcaaagcatctggttacaccttcactgactatatcacgcactgggttcgtcaggccccgggccagggtctggagtggatgggctacattaacccatacaacgacggttccaaatataccgagaaattccagggccgcgtcacgatgaccagcgacacttctatctccaccgcgtacatggaactgtctagactgcgttctgacgacaccgctgtttactattgtgcacgcggtacctactactacggtccagatctgtttgattactggggccaaggtaccacggtgaccgtaagctctgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 287 - protein, 219 aa, Artificial Sequence
  CD19 (8B8-2B03)  light chain
  misc_feature (107)..(107): Xaa can be any naturally occurring amino acid
DIVMTQTPLSLSVTPGQPASISCKSSQSLETSTGNTYLNWYLQKPGQSPQLLIYRVSKRFSGVPDRFSGSGSGTDFTLKISRVEAEDVGVYYCLQLTHVPYTFGQGXKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 288 - protein, 451 aa, Artificial Sequence
  CD19 (8B8-2B03) heavy chain
QVQLVQSGAEVKKPGASVKVSCKASGYTFTDYITHWVRQAPGQGLEWMGYINPYNDGSKYTEKFQGRVTMTSDTSISTAYMELSRLRSDDTAVYYCARGTYYYGPDLFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 289 - DNA, 657 bp, Artificial Sequence
  CD19 (8B8-5A07)  light chain DNA
gatattgttatgactcaaactccactgtctctgtccgtgaccccgggtcagccagcgagcatttcttgcaaatccagccaatctctggaaacctccaccggcaacacgtacctgaactggtatctccagaaaccgggtcagagcccgcagctgctgatctaccgtgtatctaagcgcttctccggcgttcctgatcgtttcagcggttctggatccggcaccgactttactctgaaaatcagccgtgtggaagctgaagacgttggcgtctactattgtctgcagccaggtcattacccaggtaccttcggtcaaggaactaaactggaaattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 290 - DNA, 1353 bp, Artificial Sequence
  CD19 (8B8-5A07)  heavy chain DNA
caggtgcaattggttcaatctggtgctgaagtaaaaaaaccgggcgcttccgttaaagtgagctgcaaagcatctggttacaccttcactgactatatcatgcactgggttcgtcaggccccgggccagggtctggagtggatgggctacattaacccatacaacgacggttccaaatataccgagaaattccagggccgcgtcacgatgaccagcgacacttctatctccaccgcgtacatggaactgtctagactgcgttctgacgacaccgctgtttactattgtgcacgcggtacttactactacggttccgccctctttgattactggggccaaggtaccacggtgaccgtaagctctgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 291 - protein, 219 aa, Artificial Sequence
  CD19 (8B8-5A07)  light chain
DIVMTQTPLSLSVTPGQPASISCKSSQSLETSTGNTYLNWYLQKPGQSPQLLIYRVSKRFSGVPDRFSGSGSGTDFTLKISRVEAEDVGVYYCLQPGHYPGTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 292 - protein, 451 aa, Artificial Sequence
  CD19 (8B8-5A07)  heavy chain
QVQLVQSGAEVKKPGASVKVSCKASGYTFTDYIMHWVRQAPGQGLEWMGYINPYNDGSKYTEKFQGRVTMTSDTSISTAYMELSRLRSDDTAVYYCARGTYYYGSALFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 293 - DNA, 657 bp, Artificial Sequence
  CD19 (8B8-5D08) light chain DNA
gatattgttatgactcaaactccactgtctctgtccgtgaccccgggtcagccagcgagcatttcttgcaaatccagccaatctctggaaacctccaccggcaacacgtacctgaactggtatctccagaaaccgggtcagagcccgcagctgctgatctaccgtgtatctaagcgcttctccggcgttcctgatcgtttcagcggttctggatccggcaccgactttactctgaaaatcagccgtgtggaagctgaagacgttggcgtctactattgtctgcagctgacccatgaaccatacaccttcggtcaaggaactaaactggaaattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 294 - DNA, 1353 bp, Artificial Sequence; identical to SEQ ID NO: 282
  CD19 (8B8-5D08)  heavy chain DNA

SEQ ID NO: 295 - protein, 219 aa, Artificial Sequence
  CD19 (8B8-5D08)  light chain
DIVMTQTPLSLSVTPGQPASISCKSSQSLETSTGNTYLNWYLQKPGQSPQLLIYRVSKRFSGVPDRFSGSGSGTDFTLKISRVEAEDVGVYYCLQLTHEPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 296 - protein, 451 aa, Artificial Sequence; identical to SEQ ID NO: 284
  CD19 (8B8-5D08) heavy chain

SEQ ID NO: 297 - DNA, 657 bp, Artificial Sequence
  CD19 (8B8-5B08)  light chain DNA
gatattgttatgactcaaactccactgtctctgtccgtgaccccgggtcagccagcgagcatttcttgcaaatccagccaatctctggaaacctccaccggcaacacgtacctgaactggtatctccagaaaccgggtcagagcccgcagctgctgatctaccgtgtatctaagcgcttctccggcgttcctgatcgtttcagcggttctggatccggcaccgactttactctgaaaatcagccgtgtggaagctgaagacgttggcgtctactattgtctgcagctggattcttacccaaacaccttcggtcaaggaactaaactggaaattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 298 - DNA, 1353 bp, Artificial Sequence; identical to SEQ ID NO: 278
  CD19 (8B8-5B08) heavy chain DNA

SEQ ID NO: 299 - protein, 219 aa, Artificial Sequence
  CD19 (8B8-5B08) light chain
DIVMTQTPLSLSVTPGQPASISCKSSQSLETSTGNTYLNWYLQKPGQSPQLLIYRVSKRFSGVPDRFSGSGSGTDFTLKISRVEAEDVGVYYCLQLDSYPNTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 300 - protein, 451 aa, Artificial Sequence; identical to SEQ ID NO: 280
  CD19 (8B8-5B08)  heavy chain

SEQ ID NO: 301 - DNA, 657 bp, Artificial Sequence
  CD19 (8B8-5H09) light chain DNA
gatattgttatgactcaaactccactgtctctgtccgtgaccccgggtcagccagcgagcatttcttgcaaatccagccaatctctggaatcttccaccggcaacacgtacctgaactggtatctccagaaaccgggtcagagcccgcagctgctgatctaccgtgtatctaagcgcttctccggcgttcctgatcgtttcagcggttctggatccggcaccgactttactctgaaaatcagccgtgtggaagctgaagacgttggcgtctactattgtctgcagctgatcgattacccagttaccttcggtcaaggaactaaactggaaattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 302 - DNA, 1353 bp, Artificial Sequence
  CD19 (8B8-5H09)  heavy chain DNA
caggtgcaattggttcaatctggtgctgaagtaaaaaaaccgggcgcttccgttaaagtgagctgcaaagcatctggttacaccttcactgactatatcatgcactgggttcgtcaggccccgggccagggtctggagtggatgggctacattaacccatacaacgacggttccaaatataccgagaaattccagggccgcgtcacgatgaccagcgacacttctatctccaccgcgtacatggaactgtctagactgcgttctgacgacaccgctgtttactattgtgcacgcggtacctactactacggttctgcactgtttgattactggggccaaggtaccacggtgaccgtaagctctgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 303 - protein, 219 aa, Artificial Sequence
  CD19 (8B8-5H09)  light chain
DIVMTQTPLSLSVTPGQPASISCKSSQSLESSTGNTYLNWYLQKPGQSPQLLIYRVSKRFSGVPDRFSGSGSGTDFTLKISRVEAEDVGVYYCLQLIDYPVTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 304 - protein, 451 aa, Artificial Sequence; identical to SEQ ID NO: 292
  CD19 (8B8-5H09)  heavy chain

SEQ ID NO: 305 - DNA, 1353 bp, Artificial Sequence
  CD19(8B8-2B11) Fc hole chain DNA
caggtgcaattggttcaatctggtgctgaagtaaaaaaaccgggcgcttccgttaaagtgagctgcaaagcatctggttacaccttcactgactatatcatgcactgggttcgtcaggccccgggccagggtctggagtggatgggctacattaacccatacaacgacggttccaaatataccgagaaattccagggccgcgtcacgatgaccagcgacacttctatctccaccgcgtacatggaactgtctagactgcgttctgacgacaccgctgtttactattgtgcacgcggtacctactactacggtccacagctgtttgattactggggccaaggtaccacggtgaccgtaagctctgctagcaccaagggcccctccgtgttccccctggcccccagcagcaagagcaccagcggcggcacagccgctctgggctgcctggtcaaggactacttccccgagcccgtgaccgtgtcctggaacagcggagccctgacctccggcgtgcacaccttccccgccgtgctgcagagttctggcctgtatagcctgagcagcgtggtcaccgtgccttctagcagcctgggcacccagacctacatctgcaacgtgaaccacaagcccagcaacaccaaggtggacaagaaggtggagcccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 306 - protein, 451 aa, Artificial Sequence
  CD19(8B8-2B11) Fc hole chain
QVQLVQSGAEVKKPGASVKVSCKASGYTFTDYIMHWVRQAPGQGLEWMGYINPYNDGSKYTEKFQGRVTMTSDTSISTAYMELSRLRSDDTAVYYCARGTYYYGPQLFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 307 - DNA, 2514 bp, Artificial Sequence
  CD19(8B8-2B11) Fc hole dimeric ligand chain DNA
caggtgcaattggttcaatctggtgctgaagtaaaaaaaccgggcgcttccgttaaagtgagctgcaaagcatctggttacaccttcactgactatatcatgcactgggttcgtcaggccccgggccagggtctggagtggatgggctacattaacccatacaacgacggttccaaatataccgagaaattccagggccgcgtcacgatgaccagcgacacttctatctccaccgcgtacatggaactgtctagactgcgttctgacgacaccgctgtttactattgtgcacgcggtacctactactacggtccacagctgtttgattactggggccaaggtaccacggtgaccgtaagctctgctagcaccaagggcccctccgtgttccccctggcccccagcagcaagagcaccagcggcggcacagccgctctgggctgcctggtcaaggactacttccccgagcccgtgaccgtgtcctggaacagcggagccctgacctccggcgtgcacaccttccccgccgtgctgcagagttctggcctgtatagcctgagcagcgtggtcaccgtgccttctagcagcctgggcacccagacctacatctgcaacgtgaaccacaagcccagcaacaccaaggtggacaagaaggtggagcccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtggaggcggcggaagcggaggaggaggatccagagagggccctgagctgagccccgatgatcctgctggactgctggacctgcggcagggcatgtttgctcagctggtggcccagaacgtgctgctgatcgatggccccctgtcctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgaaggatctggctctgtgtctctggccctgcatctgcagcctctgagaagcgctgctggcgctgcagctctggcactgacagtggatctgcctcctgccagctccgaggcccggaatagcgcatttgggtttcaaggcaggctgctgcacctgtctgccggccagaggctgggagtgcatctgcacacagaggccagggctagacacgcctggcagctgacacagggcgctacagtgctgggcctgttcagagtgacccccgagattccagccggcctgccttctccaagaagcgaaggcggaggcggatctggcggcggaggatctagagagggacccgaactgtcccctgacgatccagccgggctgctggatctgagacagggaatgttcgcccagctggtggctcagaatgtgctgctgattgacggacctctgagctggtactccgacccagggctggcaggggtgtccctgactgggggactgtcctacaaagaagatacaaaagaactggtggtggctaaagctggggtgtactatgtgttttttcagctggaactgaggcgggtggtggctggggagggctcaggatctgtgtccctggctctgcatctgcagccactgcgctctgctgctggcgcagctgcactggctctgactgtggacctgccaccagcctctagcgaggccagaaacagcgccttcgggttccaaggacgcctgctgcatctgagcgccggacagcgcctgggagtgcatctgcatactgaagccagagcccggcatgcttggcagctgactcagggggcaactgtgctgggactgtttcgcgtgacacctgagatccctgccggactgccaagccctagatcagaa

SEQ ID NO: 308 - DNA, 1932 bp, Artificial Sequence
  CD19(8B8-2B11) Fc knob monomeric ligand DNA
caggtgcaattggttcaatctggtgctgaagtaaaaaaaccgggcgcttccgttaaagtgagctgcaaagcatctggttacaccttcactgactatatcatgcactgggttcgtcaggccccgggccagggtctggagtggatgggctacattaacccatacaacgacggttccaaatataccgagaaattccagggccgcgtcacgatgaccagcgacacttctatctccaccgcgtacatggaactgtctagactgcgttctgacgacaccgctgtttactattgtgcacgcggtacctactactacggtccacagctgtttgattactggggccaaggtaccacggtgaccgtaagctctgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccctgcagagatgagctgaccaagaaccaggtgtccctgtggtgtctggtcaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgagccccggcggaggcggcggaagcggaggaggaggatccagagagggccctgagctgagccccgatgatcctgctggactgctggacctgcggcagggcatgtttgctcagctggtggcccagaacgtgctgctgatcgatggccccctgtcctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgaaggatctggctctgtgtctctggccctgcatctgcagcctctgagaagcgctgctggcgctgcagctctggcactgacagtggatctgcctcctgccagctccgaggcccggaatagcgcatttgggtttcaaggcaggctgctgcacctgtctgccggccagaggctgggagtgcatctgcacacagaggccagggctagacacgcctggcagctgacacagggcgctacagtgctgggcctgttcagagtgacccccgagattccagccggcctgccttctccaagaagcgaa

SEQ ID NO: 309 - protein, 838 aa, Artificial Sequence
  CD19(8B8-2B11) Fc hole dimeric ligand chain
QVQLVQSGAEVKKPGASVKVSCKASGYTFTDYIMHWVRQAPGQGLEWMGYINPYNDGSKYTEKFQGRVTMTSDTSISTAYMELSRLRSDDTAVYYCARGTYYYGPQLFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 310 - protein, 644 aa, Artificial Sequence
  CD19(8B8-2B11) Fc knob monomeric ligand
QVQLVQSGAEVKKPGASVKVSCKASGYTFTDYIMHWVRQAPGQGLEWMGYINPYNDGSKYTEKFQGRVTMTSDTSISTAYMELSRLRSDDTAVYYCARGTYYYGPQLFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 311 - DNA, 2478 bp, Artificial Sequence
  CD19(8B8-2B11) Fc hole dimeric ligand (71-248) chain DNA
caggtgcaattggttcaatctggtgctgaagtaaaaaaaccgggcgcttccgttaaagtgagctgcaaagcatctggttacaccttcactgactatatcatgcactgggttcgtcaggccccgggccagggtctggagtggatgggctacattaacccatacaacgacggttccaaatataccgagaaattccagggccgcgtcacgatgaccagcgacacttctatctccaccgcgtacatggaactgtctagactgcgttctgacgacaccgctgtttactattgtgcacgcggtacctactactacggtccacagctgtttgattactggggccaaggtaccacggtgaccgtaagctctgctagcaccaagggcccctccgtgttccccctggcccccagcagcaagagcaccagcggcggcacagccgctctgggctgcctggtcaaggactacttccccgagcccgtgaccgtgtcctggaacagcggagccctgacctccggcgtgcacaccttccccgccgtgctgcagagttctggcctgtatagcctgagcagcgtggtcaccgtgccttctagcagcctgggcacccagacctacatctgcaacgtgaaccacaagcccagcaacaccaaggtggacaagaaggtggagcccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtggaggcggcggaagcggaggaggaggatccagagagggccctgagctgagccctgatgatcctgccggactgctggacctgcggcagggaatgtttgcccagctggtggcccagaacgtgctgctgatcgatggccccctgtcctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgaaggatctggctctgtgtctctggccctgcatctgcagcctctgagatctgctgctggcgccgctgctctggcactgacagtggatctgcctcctgccagcagcgaggcccggaatagcgcatttgggtttcaaggcaggctgctgcacctgtctgccggccagaggctgggagtgcatctgcacacagaggccagggctagacacgcctggcagctgacacagggcgctacagtgctgggcctgttcagagtgacccccgagattccagcaggcctgggaggcggcggatctggcggcggaggatctagagaaggacccgagctgtcccccgacgatcccgctgggctgctggatctgagacagggcatgttcgctcagctggtggctcagaatgtgctgctgattgacggacctctgagctggtactccgacccagggctggcaggggtgtccctgactgggggactgtcctacaaagaagatacaaaagaactggtggtggctaaagctggggtgtactatgtgttttttcagctggaactgaggcgggtggtggctggggagggctcaggatctgtgtccctggctctgcatctgcagccactgcgctctgcagcaggggctgcagcactggccctgactgtggacctgcccccagcttcttccgaggccagaaacagcgccttcgggttccaaggacgcctgctgcatctgagcgccggacagcgcctgggagtgcatctgcatactgaagccagagcccggcatgcttggcagctgactcagggggcaactgtgctgggactgtttcgcgtgacacctgagatcccagccgggctc

SEQ ID NO: 312 - DNA, 1914 bp, Artificial Sequence
  CD19(8B8-2B11) Fc knob monomeric (71-248) ligand DNA
caggtgcaattggttcaatctggtgctgaagtaaaaaaaccgggcgcttccgttaaagtgagctgcaaagcatctggttacaccttcactgactatatcatgcactgggttcgtcaggccccgggccagggtctggagtggatgggctacattaacccatacaacgacggttccaaatataccgagaaattccagggccgcgtcacgatgaccagcgacacttctatctccaccgcgtacatggaactgtctagactgcgttctgacgacaccgctgtttactattgtgcacgcggtacctactactacggtccacagctgtttgattactggggccaaggtaccacggtgaccgtaagctctgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccctgcagagatgagctgaccaagaaccaggtgtccctgtggtgtctggtcaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgagccccggcggaggcggcggaagcggaggaggaggatccagagagggccctgagctgagccctgatgatcctgccggactgctggacctgcggcagggaatgtttgcccagctggtggcccagaacgtgctgctgatcgatggccccctgtcctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgaaggatctggctctgtgtctctggccctgcatctgcagcctctgagatctgctgctggcgccgctgctctggcactgacagtggatctgcctcctgccagcagcgaggcccggaatagcgcatttgggtttcaaggcaggctgctgcacctgtctgccggccagaggctgggagtgcatctgcacacagaggccagggctagacacgcctggcagctgacacagggcgctacagtgctgggcctgttcagagtgacccccgagattcctgccgggctc

SEQ ID NO: 313 - protein, 826 aa, Artificial Sequence
  CD19(8B8-2B11) Fc hole dimeric ligand (71-248) chain
QVQLVQSGAEVKKPGASVKVSCKASGYTFTDYIMHWVRQAPGQGLEWMGYINPYNDGSKYTEKFQGRVTMTSDTSISTAYMELSRLRSDDTAVYYCARGTYYYGPQLFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGL

SEQ ID NO: 314 - protein, 638 aa, Artificial Sequence
  CD19(8B8-2B11) Fc knob monomeric (71-248) ligand
QVQLVQSGAEVKKPGASVKVSCKASGYTFTDYIMHWVRQAPGQGLEWMGYINPYNDGSKYTEKFQGRVTMTSDTSISTAYMELSRLRSDDTAVYYCARGTYYYGPQLFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGL

SEQ ID NO: 315 - DNA, 1353 bp, Artificial Sequence
  CD19(8B8-018) heavy chain (huIgG1 PGLALA) DNA
caggtccagctggtgcagtccggcgccgaggtcaagaaacccggggcttctgtgaaggtttcatgcaaggcaagcggatacaccttcaccgactatatcatgcattgggtcaggcaggcccctggccaaggtctcgaatggatgggctacattaacccatataatgatggctccaaatacaccgagaagtttcagggaagagtcactatgacatctgacaccagtatcagcactgcttacatggagctgtcccgccttcggtctgatgacaccgcagtgtattactgtgccaggggcacatattactacggctcagctctgttcgactattgggggcagggaaccacagtaaccgtgagctccgcaagtactaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagcagctgggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtccccgggcaaa

SEQ ID NO: 316 - protein, 451 aa, Artificial Sequence; identical to SEQ ID NO: 292
  CD19(8B8-018) heavy chain (huIgG1 PGLALA)

SEQ ID NO: 317 - protein, 140 aa, Artificial Sequence
  anti-mu CEA T84.66 VH
MKCSWVIFFLMAVVTGVNSEVQLQQSGAELVEPGASVKLSCTASGFNIKDTYMHWVKQRPEQGLEWIGRIDPANGNSKYVPKFQGKATITADTSSNTAYLQLTSLTSEDTAVYYCAPFGYYVSDYAMAYWGQGTSVTVSS

SEQ ID NO: 318 - protein, 131 aa, Artificial Sequence
  anti-mu CEA T84.66 VL
METDTLLLWVLLLWVPGSTGDIVLTQSPASLAVSLGQRATMSCRAGESVDIFGVGFLHWYQQKPGQPPKLLIYRASNLESGIPVRFSGTGSRTDFTLIIDPVEADDVATYYCQQTNEDPYTFGGGTKLEIK

SEQ ID NO: 319 - DNA, 392 bp, Artificial Sequence
  heavy chain framework acceptor sequence
taaggggcttcctagtcctaaggctgaggaagggatcctggtttagttaaagaggattttattcacccctgtgtcctctccacaggtgtccagtcccaggtccagctggtgcaatctggggctgaggtgaagaagcctgggtcctcggtgaaggtctcctgcaaggcttctggaggcaccttcagcagctatactatcagctgggtgcgacaggcccctggacaagggcttgagtggatgggaaggatcatccctatccttggtacagcaaactacgcacagaagttccagggcagagtcacgattaccgcggacaaatccacgagcacagcctacatggagctgagcagcctgagatctgaggacacggccgtgtattactgtgcgagaga

SEQ ID NO: 320 - DNA, 797 bp, Artificial Sequence
  light chain framework acceptor sequence
ctgcagctggaagctcagctcccacccagctgctttgcatgtccctcccagctgccctaccttccagagcccatatcaatgcctgtgtcagagccctggggaggaactgctcagttaggacccagagggaaccatggaagccccagctcagcttctcttcctcctgctactctggctcccaggtgaggggaacatgaggtggttttgcacattagtgaaaactcttgccacctctgctcagcaagaaatataattaaaattcaaagtatatcaacaattttggctctactcaaagacagttggtttgatcttgattacatgagtgcatttctgttttatttccaatttcagataccaccggagaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctcccacagtgattccacatgaaacaaaaaccccaacaagaccatcagtgtttactagattattataccagctgcttcctttacagacagctagtggggtggccactcagtgttagcatctcagctctatttggccattttggagttcaagt

SEQ ID NO: 321 - protein, 5 aa, Artificial Sequence
  CEA (T84.66-LCHA) CDR-H1
DTYMH

SEQ ID NO: 322 - protein, 17 aa, Artificial Sequence
  CEA(T84.66-LCHA)  CDR-H2
RIDPANGNSKYVPKFQG

SEQ ID NO: 323 - protein, 12 aa, Artificial Sequence
  CEA(T84.66-LCHA)  CDR-H3
FGYYVSDYAMAY

SEQ ID NO: 324 - protein, 15 aa, Artificial Sequence
  CEA(T84.66-LCHA)  CDR-L1
RAGESVDIFGVGFLH

SEQ ID NO: 325 - protein, 7 aa, Artificial Sequence
  CEA(T84.66-LCHA)  CDR-L2
RASNRAT

SEQ ID NO: 326 - protein, 9 aa, Artificial Sequence
  CEA(T84.66-LCHA) CDR-L3
QQTNEDPYT

SEQ ID NO: 327 - protein, 121 aa, Artificial Sequence
  Parental CEA binder VH
EVQLQQSGAELVEPGASVKLSCTASGFNIKDTYMHWVKQRPEQGLEWIGRIDPANGNSKYVPKFQGKATITADTSSNTAYLQLTSLTSEDTAVYYCAPFGYYVSDYAMAYWGQGTSVTVSS

SEQ ID NO: 328 - protein, 111 aa, Artificial Sequence
  Parental CEA binder VL
DIVLTQSPASLAVSLGQRATMSCRAGESVDIFGVGFLHWYQQKPGQPPKLLIYRASNLESGIPVRFSGTGSRTDFTLIIDPVEADDVATYYCQQTNEDPYTFGGGTKLEIK

SEQ ID NO: 329 - protein, 242 aa, Artificial Sequence
  CEA(T84.66-LCHA) VH
QVQLVQSGAEVKKPGSSVKVSCKASGFNIKDTYMHWVRQAPGQGLEWMGRIDPANGNSKYVPKFQGRVTITADTSTSTAYMELSSLRSEDTAVYYCAPFGYYVSDYAMAYWGQGTLVTVSSQVQLVQSGAEVKKPGSSVKVSCKASGFNIKDTYMHWVRQAPGQGLEWMGRIDPANGNSKYVPKFQGRVTITADTSTSTAYMELSSLRSEDTAVYYCAPFGYYVSDYAMAYWGQGTLVTVSS

SEQ ID NO: 330 - protein, 111 aa, Artificial Sequence
  CEA(T84.66-LCHA) VL
EIVLTQSPATLSLSPGERATLSCRAGESVDIFGVGFLHWYQQKPGQAPRLLIYRASNRATGIPARFSGSGSGTDFTLTISSLEPEDFAVYYCQQTNEDPYTFGQGTKLEIK

SEQ ID NO: 331 - DNA, 1353 bp, Artificial Sequence
  CEA(T84.66-LCHA) Fc hole chain DNA
caggtgcagctggtgcagtctggcgccgaagtgaagaaacccggcagcagcgtgaaggtgtcctgcaaggccagcggcttcaacatcaaggacacctacatgcactgggtgcgccaggcccctggacagggactggaatggatgggcagaatcgaccccgccaacggcaacagcaaatacgtgcccaagttccagggcagagtgaccatcaccgccgacaccagcacctccaccgcctacatggaactgagcagcctgcggagcgaggacaccgccgtgtactactgtgcccccttcggctactacgtgtccgactacgccatggcctattggggccagggcacactcgtgaccgtgtcctctgctagcaccaagggcccctccgtgttccccctggcccccagcagcaagagcaccagcggcggcacagccgctctgggctgcctggtcaaggactacttccccgagcccgtgaccgtgtcctggaacagcggagccctgacctccggcgtgcacaccttccccgccgtgctgcagagttctggcctgtatagcctgagcagcgtggtcaccgtgccttctagcagcctgggcacccagacctacatctgcaacgtgaaccacaagcccagcaacaccaaggtggacaagaaggtggagcccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 332 - DNA, 654 bp, Artificial Sequence
  CEA(T84.66-LCHA) light chain DNA
gagatcgtgctgacccagagccctgccaccctgtcactgtctccaggcgagagagccaccctgagctgtagagccggcgagagcgtggacatcttcggcgtgggatttctgcactggtatcagcagaagcccggccaggcccccagactgctgatctacagagccagcaaccgggccacaggcatccccgccagattttctggctctggcagcggcaccgacttcaccctgacaatcagcagcctggaacccgaggacttcgccgtgtactactgccagcagaccaacgaggacccctacacctttggccagggcaccaagctggaaatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 333 - protein, 451 aa, Artificial Sequence
  CEA (T84.66-LCHA)  Fc hole chain
QVQLVQSGAEVKKPGSSVKVSCKASGFNIKDTYMHWVRQAPGQGLEWMGRIDPANGNSKYVPKFQGRVTITADTSTSTAYMELSSLRSEDTAVYYCAPFGYYVSDYAMAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 334 - protein, 218 aa, Artificial Sequence
  CEA (T84.66-LCHA)  light chain
EIVLTQSPATLSLSPGERATLSCRAGESVDIFGVGFLHWYQQKPGQAPRLLIYRASNRATGIPARFSGSGSGTDFTLTISSLEPEDFAVYYCQQTNEDPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 335 - DNA, 2514 bp, Artificial Sequence
  CEA(T84.66-LCHA)  Fc hole dimeric 4-1BBL(71-254) chain DNA
caggtgcagctggtgcagtctggcgccgaagtgaagaaacccggcagcagcgtgaaggtgtcctgcaaggccagcggcttcaacatcaaggacacctacatgcactgggtgcgccaggcccctggacagggactggaatggatgggcagaatcgaccccgccaacggcaacagcaaatacgtgcccaagttccagggcagagtgaccatcaccgccgacaccagcacctccaccgcctacatggaactgagcagcctgcggagcgaggacaccgccgtgtactactgtgcccccttcggctactacgtgtccgactacgccatggcctattggggccagggcacactcgtgaccgtgtcctctgctagcaccaagggcccctccgtgttccccctggcccccagcagcaagagcaccagcggcggcacagccgctctgggctgcctggtcaaggactacttccccgagcccgtgaccgtgtcctggaacagcggagccctgacctccggcgtgcacaccttccccgccgtgctgcagagttctggcctgtatagcctgagcagcgtggtcaccgtgccttctagcagcctgggcacccagacctacatctgcaacgtgaaccacaagcccagcaacaccaaggtggacaagaaggtggagcccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtggaggcggcggaagcggaggaggaggatccagagagggccctgagctgagccccgatgatcctgctggactgctggacctgcggcagggcatgtttgctcagctggtggcccagaacgtgctgctgatcgatggccccctgtcctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgaaggatctggctctgtgtctctggccctgcatctgcagcctctgagaagcgctgctggcgctgcagctctggcactgacagtggatctgcctcctgccagctccgaggcccggaatagcgcatttgggtttcaaggcaggctgctgcacctgtctgccggccagaggctgggagtgcatctgcacacagaggccagggctagacacgcctggcagctgacacagggcgctacagtgctgggcctgttcagagtgacccccgagattccagccggcctgccttctccaagaagcgaaggcggaggcggatctggcggcggaggatctagagagggacccgaactgtcccctgacgatccagccgggctgctggatctgagacagggaatgttcgcccagctggtggctcagaatgtgctgctgattgacggacctctgagctggtactccgacccagggctggcaggggtgtccctgactgggggactgtcctacaaagaagatacaaaagaactggtggtggctaaagctggggtgtactatgtgttttttcagctggaactgaggcgggtggtggctggggagggctcaggatctgtgtccctggctctgcatctgcagccactgcgctctgctgctggcgcagctgcactggctctgactgtggacctgccaccagcctctagcgaggccagaaacagcgccttcgggttccaaggacgcctgctgcatctgagcgccggacagcgcctgggagtgcatctgcatactgaagccagagcccggcatgcttggcagctgactcagggggcaactgtgctgggactgtttcgcgtgacacctgagatccctgccggactgccaagccctagatcagaa

SEQ ID NO: 336 - DNA, 1932 bp, Artificial Sequence
  CEA(T84.66-LCHA)  Fc knob monomeric 41-BBL (71-254) DNA
caggtgcagctggtgcagtctggcgccgaagtgaagaaacccggcagcagcgtgaaggtgtcctgcaaggccagcggcttcaacatcaaggacacctacatgcactgggtgcgccaggcccctggacagggactggaatggatgggcagaatcgaccccgccaacggcaacagcaaatacgtgcccaagttccagggcagagtgaccatcaccgccgacaccagcacctccaccgcctacatggaactgagcagcctgcggagcgaggacaccgccgtgtactactgtgcccccttcggctactacgtgtccgactacgccatggcctattggggccagggcacactcgtgaccgtgtcctctgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccctgcagagatgagctgaccaagaaccaggtgtccctgtggtgtctggtcaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgagccccggcggaggcggcggaagcggaggaggaggatccagagagggccctgagctgagccccgatgatcctgctggactgctggacctgcggcagggcatgtttgctcagctggtggcccagaacgtgctgctgatcgatggccccctgtcctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgaaggatctggctctgtgtctctggccctgcatctgcagcctctgagaagcgctgctggcgctgcagctctggcactgacagtggatctgcctcctgccagctccgaggcccggaatagcgcatttgggtttcaaggcaggctgctgcacctgtctgccggccagaggctgggagtgcatctgcacacagaggccagggctagacacgcctggcagctgacacagggcgctacagtgctgggcctgttcagagtgacccccgagattccagccggcctgccttctccaagaagcgaa

SEQ ID NO: 337 - protein, 838 aa, Artificial Sequence
  CEA(T84.66-LCHA) Fc hole dimeric 41-BBL (71-254) chain
QVQLVQSGAEVKKPGSSVKVSCKASGFNIKDTYMHWVRQAPGQGLEWMGRIDPANGNSKYVPKFQGRVTITADTSTSTAYMELSSLRSEDTAVYYCAPFGYYVSDYAMAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 338 - protein, 644 aa, Artificial Sequence
  CEA(T84.66-LCHA) Fc knob monomeric 4-1BBL (71-254) chain
QVQLVQSGAEVKKPGSSVKVSCKASGFNIKDTYMHWVRQAPGQGLEWMGRIDPANGNSKYVPKFQGRVTITADTSTSTAYMELSSLRSEDTAVYYCAPFGYYVSDYAMAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 339 - DNA, 2478 bp, Artificial Sequence
  CEA (T84.66-LCHA) Fc hole dimeric 4-1BBL (71-248) chain DNA
caggtgcagctggtgcagtctggcgccgaagtgaagaaacccggcagcagcgtgaaggtgtcctgcaaggccagcggcttcaacatcaaggacacctacatgcactgggtgcgccaggcccctggacagggactggaatggatgggcagaatcgaccccgccaacggcaacagcaaatacgtgcccaagttccagggcagagtgaccatcaccgccgacaccagcacctccaccgcctacatggaactgagcagcctgcggagcgaggacaccgccgtgtactactgtgcccccttcggctactacgtgtccgactacgccatggcctattggggccagggcacactcgtgaccgtgtcctctgctagcaccaagggcccctccgtgttccccctggcccccagcagcaagagcaccagcggcggcacagccgctctgggctgcctggtcaaggactacttccccgagcccgtgaccgtgtcctggaacagcggagccctgacctccggcgtgcacaccttccccgccgtgctgcagagttctggcctgtatagcctgagcagcgtggtcaccgtgccttctagcagcctgggcacccagacctacatctgcaacgtgaaccacaagcccagcaacaccaaggtggacaagaaggtggagcccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtggaggcggcggaagcggaggaggaggatccagagagggccctgagctgagccctgatgatcctgccggactgctggacctgcggcagggaatgtttgcccagctggtggcccagaacgtgctgctgatcgatggccccctgtcctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgaaggatctggctctgtgtctctggccctgcatctgcagcctctgagatctgctgctggcgccgctgctctggcactgacagtggatctgcctcctgccagcagcgaggcccggaatagcgcatttgggtttcaaggcaggctgctgcacctgtctgccggccagaggctgggagtgcatctgcacacagaggccagggctagacacgcctggcagctgacacagggcgctacagtgctgggcctgttcagagtgacccccgagattccagcaggcctgggaggcggcggatctggcggcggaggatctagagaaggacccgagctgtcccccgacgatcccgctgggctgctggatctgagacagggcatgttcgctcagctggtggctcagaatgtgctgctgattgacggacctctgagctggtactccgacccagggctggcaggggtgtccctgactgggggactgtcctacaaagaagatacaaaagaactggtggtggctaaagctggggtgtactatgtgttttttcagctggaactgaggcgggtggtggctggggagggctcaggatctgtgtccctggctctgcatctgcagccactgcgctctgcagcaggggctgcagcactggccctgactgtggacctgcccccagcttcttccgaggccagaaacagcgccttcgggttccaaggacgcctgctgcatctgagcgccggacagcgcctgggagtgcatctgcatactgaagccagagcccggcatgcttggcagctgactcagggggcaactgtgctgggactgtttcgcgtgacacctgagatcccagccgggctc

SEQ ID NO: 340 - DNA, 1914 bp, Artificial Sequence
  CEA (T84.66-LCHA) Fc knob monomeric (71-248) 4-1BBL chain DNA
caggtgcagctggtgcagtctggcgccgaagtgaagaaacccggcagcagcgtgaaggtgtcctgcaaggccagcggcttcaacatcaaggacacctacatgcactgggtgcgccaggcccctggacagggactggaatggatgggcagaatcgaccccgccaacggcaacagcaaatacgtgcccaagttccagggcagagtgaccatcaccgccgacaccagcacctccaccgcctacatggaactgagcagcctgcggagcgaggacaccgccgtgtactactgtgcccccttcggctactacgtgtccgactacgccatggcctattggggccagggcacactcgtgaccgtgtcctctgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccctgcagagatgagctgaccaagaaccaggtgtccctgtggtgtctggtcaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgagccccggcggaggcggcggaagcggaggaggaggatccagagagggccctgagctgagccctgatgatcctgccggactgctggacctgcggcagggaatgtttgcccagctggtggcccagaacgtgctgctgatcgatggccccctgtcctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgaaggatctggctctgtgtctctggccctgcatctgcagcctctgagatctgctgctggcgccgctgctctggcactgacagtggatctgcctcctgccagcagcgaggcccggaatagcgcatttgggtttcaaggcaggctgctgcacctgtctgccggccagaggctgggagtgcatctgcacacagaggccagggctagacacgcctggcagctgacacagggcgctacagtgctgggcctgttcagagtgacccccgagattcctgccgggctc

SEQ ID NO: 341 - protein, 826 aa, Artificial Sequence
  CEA (T84.66-LCHA) Fc hole dimeric 4-1BBL (71-248) chain
QVQLVQSGAEVKKPGSSVKVSCKASGFNIKDTYMHWVRQAPGQGLEWMGRIDPANGNSKYVPKFQGRVTITADTSTSTAYMELSSLRSEDTAVYYCAPFGYYVSDYAMAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGL

SEQ ID NO: 342 - protein, 638 aa, Artificial Sequence
  CEA (T84.66-LCHA) Fc knob monomeric (71-248) 4-1BBL chain
QVQLVQSGAEVKKPGSSVKVSCKASGFNIKDTYMHWVRQAPGQGLEWMGRIDPANGNSKYVPKFQGRVTITADTSTSTAYMELSSLRSEDTAVYYCAPFGYYVSDYAMAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGL

SEQ ID NO: 343 - DNA, 1353 bp, Artificial Sequence
  CEA(T84.66) Fc hole chain DNA
gaggtgcagctgcagcagtctggcgccgaactggtggaacctggcgcctctgtgaagctgagctgtaccgccagcggcttcaacatcaaggacacctacatgcactgggtcaagcagcggcctgagcagggcctggaatggatcggcagaatcgaccccgccaacggcaacagcaaatacgtgcccaagttccagggcaaggccaccatcaccgccgacaccagcagcaacacagcctacctgcagctgaccagcctgacctccgaggacaccgccgtgtactactgcgcccccttcggctactacgtgtccgactacgccatggcctattggggccagggcacaagcgtgaccgtgtcctctgctagcaccaagggcccctccgtgttccccctggcccccagcagcaagagcaccagcggcggcacagccgctctgggctgcctggtcaaggactacttccccgagcccgtgaccgtgtcctggaacagcggagccctgacctccggcgtgcacaccttccccgccgtgctgcagagttctggcctgtatagcctgagcagcgtggtcaccgtgccttctagcagcctgggcacccagacctacatctgcaacgtgaaccacaagcccagcaacaccaaggtggacaagaaggtggagcccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 344 - DNA, 654 bp, Artificial Sequence
  anti- CEA(T84.66) light chain DNA
gacatcgtgctgacccagagccctgcctctctggccgtgtctctgggacagagggccaccatgtcttgcagagccggcgagagcgtggacatcttcggcgtgggatttctgcactggtatcagcagaagcccggccagccccccaagctgctgatctacagagccagcaacctggaaagcggcatccccgtgcggtttagcggcaccggcagcagaaccgacttcaccctgatcatcgaccccgtggaagccgacgacgtggccacctactactgccagcagaccaacgaggacccctacacctttggcggaggcaccaagctggaaatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 345 - protein, 451 aa, Artificial Sequence
  CEA (T84.66) Fc hole chain
EVQLQQSGAELVEPGASVKLSCTASGFNIKDTYMHWVKQRPEQGLEWIGRIDPANGNSKYVPKFQGKATITADTSSNTAYLQLTSLTSEDTAVYYCAPFGYYVSDYAMAYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 346 - protein, 218 aa, Artificial Sequence
  CEA (T84.66)  light chain
DIVLTQSPASLAVSLGQRATMSCRAGESVDIFGVGFLHWYQQKPGQPPKLLIYRASNLESGIPVRFSGTGSRTDFTLIIDPVEADDVATYYCQQTNEDPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 347 - DNA, 2514 bp, Artificial Sequence
  CEA(T84.66)  Fc hole dimeric 4-1BBL (71-254)  chain DNA
gaggtgcagctgcagcagtctggcgccgaactggtggaacctggcgcctctgtgaagctgagctgtaccgccagcggcttcaacatcaaggacacctacatgcactgggtcaagcagcggcctgagcagggcctggaatggatcggcagaatcgaccccgccaacggcaacagcaaatacgtgcccaagttccagggcaaggccaccatcaccgccgacaccagcagcaacacagcctacctgcagctgaccagcctgacctccgaggacaccgccgtgtactactgcgcccccttcggctactacgtgtccgactacgccatggcctattggggccagggcacaagcgtgaccgtgtcctctgctagcaccaagggcccctccgtgttccccctggcccccagcagcaagagcaccagcggcggcacagccgctctgggctgcctggtcaaggactacttccccgagcccgtgaccgtgtcctggaacagcggagccctgacctccggcgtgcacaccttccccgccgtgctgcagagttctggcctgtatagcctgagcagcgtggtcaccgtgccttctagcagcctgggcacccagacctacatctgcaacgtgaaccacaagcccagcaacaccaaggtggacaagaaggtggagcccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtggaggcggcggaagcggaggaggaggatccagagagggccctgagctgagccccgatgatcctgctggactgctggacctgcggcagggcatgtttgctcagctggtggcccagaacgtgctgctgatcgatggccccctgtcctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgaaggatctggctctgtgtctctggccctgcatctgcagcctctgagaagcgctgctggcgctgcagctctggcactgacagtggatctgcctcctgccagctccgaggcccggaatagcgcatttgggtttcaaggcaggctgctgcacctgtctgccggccagaggctgggagtgcatctgcacacagaggccagggctagacacgcctggcagctgacacagggcgctacagtgctgggcctgttcagagtgacccccgagattccagccggcctgccttctccaagaagcgaaggcggaggcggatctggcggcggaggatctagagagggacccgaactgtcccctgacgatccagccgggctgctggatctgagacagggaatgttcgcccagctggtggctcagaatgtgctgctgattgacggacctctgagctggtactccgacccagggctggcaggggtgtccctgactgggggactgtcctacaaagaagatacaaaagaactggtggtggctaaagctggggtgtactatgtgttttttcagctggaactgaggcgggtggtggctggggagggctcaggatctgtgtccctggctctgcatctgcagccactgcgctctgctgctggcgcagctgcactggctctgactgtggacctgccaccagcctctagcgaggccagaaacagcgccttcgggttccaaggacgcctgctgcatctgagcgccggacagcgcctgggagtgcatctgcatactgaagccagagcccggcatgcttggcagctgactcagggggcaactgtgctgggactgtttcgcgtgacacctgagatccctgccggactgccaagccctagatcagaa

SEQ ID NO: 348 - DNA, 1932 bp, Artificial Sequence
  CEA(T84.66)  Fc knob monomeric 4-1BBL (72-254) chain DNA
gaggtgcagctgcagcagtctggcgccgaactggtggaacctggcgcctctgtgaagctgagctgtaccgccagcggcttcaacatcaaggacacctacatgcactgggtcaagcagcggcctgagcagggcctggaatggatcggcagaatcgaccccgccaacggcaacagcaaatacgtgcccaagttccagggcaaggccaccatcaccgccgacaccagcagcaacacagcctacctgcagctgaccagcctgacctccgaggacaccgccgtgtactactgcgcccccttcggctactacgtgtccgactacgccatggcctattggggccagggcacaagcgtgaccgtgtcctctgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccctgcagagatgagctgaccaagaaccaggtgtccctgtggtgtctggtcaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgagccccggcggaggcggcggaagcggaggaggaggatccagagagggccctgagctgagccccgatgatcctgctggactgctggacctgcggcagggcatgtttgctcagctggtggcccagaacgtgctgctgatcgatggccccctgtcctggtacagcgatcctggactggctggcgtgtcactgacaggcggcctgagctacaaagaggacaccaaagaactggtggtggccaaggccggcgtgtactacgtgttctttcagctggaactgcggagagtggtggccggcgaaggatctggctctgtgtctctggccctgcatctgcagcctctgagaagcgctgctggcgctgcagctctggcactgacagtggatctgcctcctgccagctccgaggcccggaatagcgcatttgggtttcaaggcaggctgctgcacctgtctgccggccagaggctgggagtgcatctgcacacagaggccagggctagacacgcctggcagctgacacagggcgctacagtgctgggcctgttcagagtgacccccgagattccagccggcctgccttctccaagaagcgaa

SEQ ID NO: 349 - protein, 838 aa, Artificial Sequence
  CEA(T84.66) Fc hole dimeric 4-1BBL(71-254) chain
EVQLQQSGAELVEPGASVKLSCTASGFNIKDTYMHWVKQRPEQGLEWIGRIDPANGNSKYVPKFQGKATITADTSSNTAYLQLTSLTSEDTAVYYCAPFGYYVSDYAMAYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 350 - protein, 644 aa, Artificial Sequence
  CEA(T84.66) Fc knob monomeric 4-1BBL (71-254) chain
EVQLQQSGAELVEPGASVKLSCTASGFNIKDTYMHWVKQRPEQGLEWIGRIDPANGNSKYVPKFQGKATITADTSSNTAYLQLTSLTSEDTAVYYCAPFGYYVSDYAMAYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 351 - DNA, 1287 bp, Artificial Sequence
  hu NA3B3A2-avi His DNA
cagctgaccaccgagtccatgcccttcaacgtggccgagggcaaagaggtgctgctgctggtccacaacctgccccagcagctgttcggctacagctggtacaagggcgagcgggtggacggcaaccggcagatcgtgggctacgccatcggcacccagcaggccacacccggccctgccaatagcggcagagagacaatctaccccaacgccagcctgctgatccagaacgtgacccagaacgacaccggcttctacacactccaagtcatcaagagcgacctggtcaacgaggaagccaccggccagttccacgtgtaccccgagctgcccaagcccagcatcagcagcaacaacagcaagcccgtggaagataaggacgccgtggcctttacctgcgagcccgaggcccagaacaccacctacctgtggtgggtcaacggccagagcctgcccgtgtcccccagactccagctgagcaacggcaacagaaccctgaccctgttcaacgtgacccggaatgacgccagagcctacgtgtgcggcatccagaacagcgtgtccgccaaccgcagcgaccccgtgaccctggatgtgctgtacggccccgacacccccatcatcagcccccctgacagcagctacctgagcggcgccaacctgaacctgagctgccacagcgccagcaaccccagccctcagtacagctggcggatcaacggcatcccccagcagcacacccaggtgctgtttatcgccaagatcacccccaacaacaacggcacctacgcctgcttcgtgtccaacctggccaccggccggaacaacagcatcgtgaagtccatcaccgtgtccgcctccctgagccccgtggtggccaagcctcagatcaaggccagcaagaccaccgtgaccggcgacaaggacagcgtgaacctgacctgctccaccaacgataccggcatcagcatccggtggttcttcaagaatcagtccctgcccagcagcgagcggatgaagctgagccagggcaacatcaccctgtccatcaaccccgtgaaaagagaggacgccggcacctattggtgcgaggtgttcaaccccatcagcaagaaccagagcgaccccatcatgctgaacgtgaactacaacgccctgccccaagaaaacctgatcaatgttgatctggaagtgctgttccagggcccaggcagcggcctgaacgacatcttcgaagcccagaaaatcgagtggcacgaggccagagcccaccaccaccatcaccac

SEQ ID NO: 352 - protein, 429 aa, Artificial Sequence
  hu NA3B3A2-avi-His
QLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASLSPVVAKPQIKASKTTVTGDKDSVNLTCSTNDTGISIRWFFKNQSLPSSERMKLSQGNITLSINPVKREDAGTYWCEVFNPISKNQSDPIMLNVNYNALPQENLINVDLEVLFQGPGSGLNDIFEAQKIEWHEARAHHHHHH

SEQ ID NO: 353 - DNA, 1860 bp, Artificial Sequence
  Dimeric hu OX40L (51-183) - CL* Fc knob chain DNA
caggtgtcccacagataccccagaatccagagcatcaaggtgcagttcaccgagtacaagaaagagaagggcttcatcctgaccagccagaaagaggacgagatcatgaaggtgcaggacaacagcgtgatcatcaactgcgacggcttctacctgatcagcctgaagggctacttcagccaggaagtggacatcagcctgcactaccagaaggacgaggaacccctgttccagctgaagaaagtgcggagcgtgaacagcctgatggtggccagcctgacctacaaggacaaggtgtacctgaacgtgaccaccgacaacaccagcctggacgacttccacgtgaacggcggcgagctgatcctgattcaccagaaccccggcgagttctgcgtgctgggaggcggaggatctggcggaggcggatctcaggtgtcacaccgctacccccggattcagtccattaaggtgcagtttacagagtataagaaagaaaaaggctttattctgacttcccagaaagaagatgagattatgaaggtgcaggataattctgtgatcatcaattgtgacggcttctacctgatcagcctgaagggctacttcagccaggaagtggacatcagcctgcactaccagaaggacgaggaacccctgttccagctgaagaaagtgcggagcgtgaacagcctgatggtggccagcctgacctacaaggacaaggtgtacctgaacgtgaccaccgacaacaccagcctggacgacttccacgtgaacggcggcgagctgatcctgatccaccagaaccctggcgagttctgcgtgctgggaggcggaggctccggagggggaggatctcgtacggtggctgcaccatctgtctttatcttcccacccagcgaccggaagctgaagtctggcacagccagcgtcgtgtgcctgctgaataacttctacccccgcgaggccaaggtgcagtggaaggtggacaatgccctgcagagcggcaacagccaggaaagcgtgaccgagcaggacagcaaggactccacctacagcctgagcagcaccctgaccctgagcaaggccgactacgagaagcacaaggtgtacgcctgcgaagtgacccaccagggcctgtctagccccgtgaccaagagcttcaaccggggcgagtgcgacaagacccacacctgtcctccatgccctgcccctgaagctgctggcggccctagcgtgttcctgttccccccaaagcccaaggacaccctgatgatcagccggacccctgaagtgacctgcgtggtggtggatgtgtcccacgaggaccctgaagtgaagttcaattggtacgtggacggcgtggaagtgcacaatgccaagaccaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 354 - DNA, 738 bp, Artificial Sequence
  Monomeric hu OX40L (51-183) - CH1* DNA
caggtgtcccacagataccccagaatccagagcatcaaggtgcagttcaccgagtacaagaaagagaagggcttcatcctgaccagccagaaagaggacgagatcatgaaggtgcaggacaacagcgtgatcatcaactgcgacggcttctacctgatcagcctgaagggctacttcagccaggaagtggacatcagcctgcactaccagaaggacgaggaacccctgttccagctgaagaaagtgcggagcgtgaacagcctgatggtggccagcctgacctacaaggacaaggtgtacctgaacgtgaccaccgacaacaccagcctggacgacttccacgtgaacggcggcgagctgatcctgattcaccagaaccccggcgagttctgcgtgctgggaggcggaggttccggaggcggaggatctgctagcacaaagggccccagcgtgttccctctggcccctagcagcaagagcacatctggcggaacagccgccctgggctgcctggtggaagattacttccccgagcccgtgaccgtgtcctggaattctggcgccctgacaagcggcgtgcacacctttccagccgtgctgcagagcagcggcctgtactctctgagcagcgtcgtgacagtgcccagcagctctctgggcacccagacctacatctgcaacgtgaaccacaagcccagcaacaccaaggtggacgagaaggtggaacccaagtcctgc

SEQ ID NO: 355 - protein, 620 aa, Artificial Sequence
  Dimeric hu OX40L (51-183)  - CL* Fc knob chain
QVSHRYPRIQSIKVQFTEYKKEKGFILTSQKEDEIMKVQDNSVIINCDGFYLISLKGYFSQEVDISLHYQKDEEPLFQLKKVRSVNSLMVASLTYKDKVYLNVTTDNTSLDDFHVNGGELILIHQNPGEFCVLGGGGSGGGGSQVSHRYPRIQSIKVQFTEYKKEKGFILTSQKEDEIMKVQDNSVIINCDGFYLISLKGYFSQEVDISLHYQKDEEPLFQLKKVRSVNSLMVASLTYKDKVYLNVTTDNTSLDDFHVNGGELILIHQNPGEFCVLGGGGSGGGGSRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGECDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 356 - protein, 246 aa, Artificial Sequence
  Monomeric hu OX40L (51-183) - CH1*
QVSHRYPRIQSIKVQFTEYKKEKGFILTSQKEDEIMKVQDNSVIINCDGFYLISLKGYFSQEVDISLHYQKDEEPLFQLKKVRSVNSLMVASLTYKDKVYLNVTTDNTSLDDFHVNGGELILIHQNPGEFCVLGGGGSGGGGSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSC

SEQ ID NO: 357 - protein, 121 aa, Artificial Sequence
  CD19 (8B8-2B11) VH
QVQLVQSGAEVKKPGASVKVSCKASGYTFTDYIMHWVRQAPGQGLEWMGYINPYNDGSKYTEKFQGRVTMTSDTSISTAYMELSRLRSDDTAVYYCARGTYYYGPQLFDYWGQGTTVTVSS

SEQ ID NO: 358 - protein, 112 aa, Artificial Sequence
  CD19 (8B8-2B11) VL
DIVMTQTPLSLSVTPGQPASISCKSSQSLETSTGTTYLNWYLQKPGQSPQLLIYRVSKRFSGVPDRFSGSGSGTDFTLKISRVEAEDVGVYYCLQLLEDPYTFGQGTKLEIK

SEQ ID NO: 359 - protein, 121 aa, Artificial Sequence
  CD19 (8B8-7H07) VH
QVQLVQSGAEVKKPGASVKVSCKASGYTFTDYIMHWVRQAPGQGLEWMGYINPYNDGSKYTEKFQGRVTMTSDTSISTAYMELSRLRSDDTAVYYCARGTYYYGSELFDYWGQGTTVTVSS

SEQ ID NO: 360 - protein, 112 aa, Artificial Sequence
  CD19 (8B8-7H07) VL
DIVMTQTPLSLSVTPGQPASISCKSSQSLETSTGNTYLNWYLQKPGQSPQLLIYRVSKRFSGVPDRFSGSGSGTDFTLKISRVEAEDVGVYYCLQATHIPYTFGQGTKLEIK

SEQ ID NO: 361 - protein, 121 aa, Artificial Sequence
  CD19 (8B8-2B03) VH
QVQLVQSGAEVKKPGASVKVSCKASGYTFTDYITHWVRQAPGQGLEWMGYINPYNDGSKYTEKFQGRVTMTSDTSISTAYMELSRLRSDDTAVYYCARGTYYYGPDLFDYWGQGTTVTVSS

SEQ ID NO: 362 - protein, 112 aa, Artificial Sequence
  CD19 (8B8-2B03) VL
  misc_feature (107)..(107): Xaa can be any naturally occurring amino acid
DIVMTQTPLSLSVTPGQPASISCKSSQSLETSTGNTYLNWYLQKPGQSPQLLIYRVSKRFSGVPDRFSGSGSGTDFTLKISRVEAEDVGVYYCLQLTHVPYTFGQGXKLEIK

SEQ ID NO: 363 - protein, 121 aa, Artificial Sequence; identical to SEQ ID NO: 201
  CD19 (8B8-5A07) VH

SEQ ID NO: 364 - protein, 112 aa, Artificial Sequence
  CD19 (8B8-5A07) VL
DIVMTQTPLSLSVTPGQPASISCKSSQSLETSTGNTYLNWYLQKPGQSPQLLIYRVSKRFSGVPDRFSGSGSGTDFTLKISRVEAEDVGVYYCLQPGHYPGTFGQGTKLEIK

SEQ ID NO: 365 - protein, 121 aa, Artificial Sequence; identical to SEQ ID NO: 359
  CD19 (8B8-5D08) VH

SEQ ID NO: 366 - protein, 112 aa, Artificial Sequence
  CD19 (8B8-5D08) VL
DIVMTQTPLSLSVTPGQPASISCKSSQSLETSTGNTYLNWYLQKPGQSPQLLIYRVSKRFSGVPDRFSGSGSGTDFTLKISRVEAEDVGVYYCLQLTHEPYTFGQGTKLEIK

SEQ ID NO: 367 - protein, 121 aa, Artificial Sequence; identical to SEQ ID NO: 357
  CD19 (8B8-5B08) VH

SEQ ID NO: 368 - protein, 112 aa, Artificial Sequence
  CD19 (8B8-5B08) VL
DIVMTQTPLSLSVTPGQPASISCKSSQSLETSTGNTYLNWYLQKPGQSPQLLIYRVSKRFSGVPDRFSGSGSGTDFTLKISRVEAEDVGVYYCLQLDSYPNTFGQGTKLEIK

SEQ ID NO: 369 - protein, 121 aa, Artificial Sequence; identical to SEQ ID NO: 201
  CD19 (8B8-5H09) VH

SEQ ID NO: 370 - protein, 112 aa, Artificial Sequence
  CD19 (8B8-5H09) VL
DIVMTQTPLSLSVTPGQPASISCKSSQSLESSTGNTYLNWYLQKPGQSPQLLIYRVSKRFSGVPDRFSGSGSGTDFTLKISRVEAEDVGVYYCLQLIDYPVTFGQGTKLEIK

SEQ ID NO: 371 - protein, 276 aa, Artificial Sequence
  dimeric huOX40L (51-183) connected by (G4S)2 linker
QVSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVLGGGGSGGGGSQVSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 372 - protein, 274 aa, Artificial Sequence
  dimeric huOX40L (52-183) connected by (G4S)2 linker
VSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVLGGGGSGGGGSVSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 373 - protein, 164 aa, Artificial Sequence
  hu 4-1BBL (85-248)
LDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGL

SEQ ID NO: 374 - protein, 169 aa, Artificial Sequence
  hu 4-1BBL (80-248)
DPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGL

SEQ ID NO: 375 - protein, 197 aa, Artificial Sequence
  hu 4-1BBL (52-248)
PWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGL

What is claimed is:

1. A tumor necrosis factor (TNF) family ligand trimer-containing antigen-binding molecule comprising
   (a) at least one antigen-binding domain comprising an antibody light chain variable region (VL) and an antibody heavy chain variable region (VH) capable of specific binding to a target cell antigen wherein the target cell antigen is Fibroblast Activation Protein (FAP) and
   (b) a first and a second polypeptide that are linked to each other by a disulfide bond,
   wherein the first polypeptide comprises two ectodomains of a TNF ligand family member or a fragment thereof that are connected to each other by a peptide linker and the second polypeptide comprises only one ectodomain of the TNF ligand family member or a fragment thereof, wherein the TNF ligand family member is 4-1BBL and wherein the antigen-binding molecule activates the NFκB signaling pathway.

2. The TNF family ligand trimer-containing antigen-binding molecule of claim 1, further comprising
   (c) an Fc domain composed of a first and a second subunit wherein the first and the second subunit are capable of stable association with each other.

3. The TNF family ligand trimer-containing antigen-binding molecule of claim 1, wherein
   (i) the first polypeptide comprises an antibody heavy chain constant domain 1 (CH1) or an antibody light chain constant domain (CL) and the second polypeptide contains a CL or CH1 domain, wherein the second polypeptide is linked to the first polypeptide by a disulfide bond between the CH1 and CL domain, and wherein the first polypeptide comprises two ectodomains of a TNF ligand family member or fragments thereof that are connected to each other and to the CH1 or CL domain by a peptide linker and wherein the second polypeptide comprises one ectodomain of the TNF ligand family member or a fragment thereof connected via a peptide linker to the CL or CH1 domain of the second polypeptide, or
   (ii) the first polypeptide comprises an antibody heavy chain constant domain 3 (CH3) domain and the second polypeptide contains a CH3 domain, and wherein the first polypeptide comprises two ectodomains of a TNF ligand family member or fragments thereof that are connected to each other and to the C-terminus of the CH3 domain by a peptide linker and wherein the second polypeptide comprises only one ectodomain of the TNF ligand family member or a fragment thereof connected via a peptide linker to C-terminus of the CH3 domain of the second polypeptide, or
   (iii) the first polypeptide comprises an antibody heavy chain variable domain-light chain constant domain (VH-CL) or an antibody light chain variable domain-heavy chain constant domain (VL-CH1) and the second polypeptide contains a VL-CH1 or a VH-CL, wherein the second polypeptide is linked to the first polypeptide by a disulfide bond between the CH1 and CL domain, and wherein the first polypeptide comprises two ectodomains of a TNF ligand family member or fragments thereof that are connected to each other and to the VH or the VL by a peptide linker and wherein the second polypeptide comprises one ectodomain of the TNF ligand family member or a fragment thereof connected via a peptide linker to the VL or the VH of the second polypeptide.

4. The TNF family ligand trimer-containing antigen-binding molecule of claim 1, wherein the TNF ligand family member costimulates human T-cell activation.

5. The TNF family ligand trimer-containing antigen-binding molecule of claim 1, wherein the ectodomain of the TNF ligand family member comprises the amino acid sequence selected from the group consisting of SEQ ID NO:1, SEQ ID NO: 2, SEQ ID NO:3, SEQ ID NO:4, SEQ ID NO:96, SEQ ID NO: 373, SEQ ID NO:374 and SEQ ID NO:375.

6. The TNF family ligand trimer-containing antigen-binding molecule of claim 1, wherein the ectodomain of the TNF ligand family member comprises the amino acid sequence of SEQ ID NO:96.

7. The TNF family ligand trimer-containing antigen-binding molecule of claim 1, wherein the first polypeptide comprises the amino acid sequence selected from the group consisting of SEQ ID NO:5, SEQ ID NO:97, SEQ ID NO:98 and SEQ ID NO:99 and the second polypeptide comprises the amino acid sequence selected from the group consisting of SEQ ID NO:1, SEQ ID NO:96, SEQ ID NO:3 and SEQ ID NO:4.

8. The TNF family ligand trimer-containing antigen-binding molecule of claim 1, wherein the antigen-binding domain capable of specific binding to a target cell antigen is selected from the group consisting of an antibody fragment, a Fab molecule, a crossover Fab molecule, a single chain Fab molecule, a Fv molecule, a scFv molecule, a single domain antibody, an aVH and a scaffold antigen-binding protein.

9. The TNF family ligand trimer-containing antigen-binding molecule of claim 1, wherein the molecule comprises one antigen-binding domain capable of specific binding to a target cell antigen.

10. The TNF family ligand trimer-containing antigen-binding molecule claim 1, wherein the antigen-binding domain capable of specific binding to a target cell antigen is a Fab molecule.

11. The TNF family ligand trimer-containing antigen-binding molecule of claim 1, wherein the VH comprises (i) CDR-H1 comprising the amino acid sequence of SEQ ID NO:7 or SEQ ID NO:100, (ii) CDR-H2 comprising the amino acid sequence of SEQ ID NO:8 or SEQ ID NO:101, and (iii) CDR-H3 comprising the amino acid sequence of SEQ ID NO:9 or SEQ ID NO:102, and the VL comprises (iv) CDR-L1 comprising the amino acid sequence of SEQ ID NO:10 or SEQ ID NO:103, (v) CDR-L2 comprising the amino acid sequence of SEQ ID NO:11 or SEQ ID NO:104, and (vi) CDR-L3 comprising the amino acid sequence of SEQ ID NO:12 or SEQ ID NO:105.

12. The TNF family ligand trimer-containing antigen-binding molecule of claim 1, wherein the antibody-binding domain capable of specific binding to FAP comprises a variable heavy chain comprising an amino acid sequence of SEQ ID NO:16 and a variable light chain comprising an amino acid sequence of SEQ ID NO:17 or wherein the antibody-binding domain capable of specific binding to FAP comprises a variable heavy chain comprising an amino acid sequence of SEQ ID NO:106 and a variable light chain comprising an amino acid sequence of SEQ ID NO:107.

13. The TNF family ligand trimer-containing antigen binding molecule of claim 1, wherein the first polypeptide comprises an antibody CH3 domain and the second polypeptide comprises an antibody CH3 domain, and wherein the first polypeptide comprises two ectodomains of the TNF ligand family member or fragments thereof that are connected to each other and to the C-terminus of the CH3 domain by a peptide linker and wherein the second polypeptide comprises one ectodomain of the TNF ligand family member or fragment thereof connected via a peptide linker to C-terminus of the CH3 domain of the polypeptide.

14. The TNF family ligand trimer-containing antigen-binding molecule of claim 13, comprising two antibody-binding domains capable of specific binding to a target cell antigen.

15. A pharmaceutical composition comprising the TNF family ligand trimer-containing antigen-binding molecule of claim 1 and at least one pharmaceutically acceptable excipient.

16. The TNF family ligand trimer-containing antigen-binding molecule of claim 1, wherein the ectodomain of the TNF ligand family member comprises the amino acid sequence of SEQ ID NO:1.

17. The TNF family ligand trimer-containing antigen-binding molecule of claim 2, wherein the Fc domain is an IgG domain.

18. The TNF family ligand trimer-containing antigen-binding molecule of claim 2, wherein the Fc domain is an IgG1 Fc domain comprising the amino acid substitutions at positions 234 and 235 (EU numbering) and/or 329 (EU numbering) of the IgG heavy chain.

19. The TNF family ligand trimer-containing antigen-binding molecule of claim 2, wherein the Fc domain is an IgG1 Fc domain or an IgG4 Fc domain.

20. A tumor necrosis factor (TNF) family ligand trimer-containing antigen-binding molecule comprising
(a) a first heavy chain and a first light chain, both comprising a Fab molecule capable of specific binding to a target cell antigen, wherein the target cell antigen is Fibroblast Activation Protein (FAP),
(b) a first peptide comprising two ectodomains of a TNF ligand family member or fragments thereof connected to each other by a first peptide linker fused at its C-terminus by a second peptide linker to a second heavy or light chain, and
(c) a second peptide comprising one ectodomain of the TNF ligand family member fused at its C-terminus by a third peptide linker to a second light or heavy chain, wherein the TNF ligand family member is 4-1BBL and wherein the antigen-binding molecule activates the NFκB signaling pathway.

21. The TNF family ligand trimer-containing antigen-binding molecule of claim 20, wherein the first peptide comprising two ectodomains of a TNF ligand family member or fragments thereof connected to each other by a first peptide linker is fused at its C-terminus by a second peptide linker to a CH1 domain that is part of an antibody heavy chain,
and the second peptide comprising one ectodomain of the TNF ligand family member or a fragment thereof is fused at its C-terminus by a third peptide linker to a CL domain that is part of an antibody light chain.

22. The TNF family ligand trimer-containing antigen-binding molecule of claim 20, wherein the first peptide comprising two ectodomains of a TNF ligand family member or fragments thereof connected to each other by a first peptide linker is fused at its C-terminus by a second peptide linker to a CL domain that is part of an antibody heavy chain, and the second peptide comprising one ectodomain of the TNF ligand family member or a fragment thereof is fused at its C-terminus by a third peptide linker to a CH1 domain that is part of an antibody light chain.

23. The TNF family ligand trimer-containing antigen-binding molecule of claim 20, wherein the first peptide comprising two ectodomains of a TNF ligand family member or fragments thereof connected to each other by a first peptide linker is fused at its C-terminus by a second peptide linker to a VH domain that is part of an antibody heavy chain, and the second peptide comprising one ectodomain of the TNF ligand family member or a fragment thereof is fused at its C-terminus by a third peptide linker to a VL domain that is part of an antibody light chain.

24. The TNF family ligand trimer-containing antigen-binding molecule of claim 22, wherein in the CL domain adjacent to the TNF ligand family member the amino acid at position 123 of the light chain (EU numbering) has been replaced by arginine (R) and the amino acid at position 124 of the light chain (EU numbering) has been substituted by lysine (K), and wherein in the CH1 domain adjacent to the TNF ligand family member the amino acids at position 147 of the heavy chain (EU numbering) and at position 213 of the heavy chain (EU numbering) have been substituted by glutamic acid (E).

25. A tumor necrosis factor (TNF) family ligand trimer-containing antigen-binding molecule comprising
(a) a first antibody heavy chain and a first antibody light chain, both comprising a Fab molecule capable of specific binding to a target cell antigen, wherein the target cell antigen is Fibroblast Activation Protein (FAP)
(b) a second antibody heavy chain comprising an amino acid sequence selected from the group consisting of SEQ ID NO:5, SEQ ID NO:97, SEQ ID NO:98 and SEQ ID NO:99, and a second antibody light chain comprising an amino acid sequence selected from the group consisting of SEQ ID NO:1, SEQ ID NO:96, SEQ ID NO:3 and SEQ ID NO:4.

26. A tumor necrosis factor (TNF) family ligand trimer-containing antigen-binding molecule capable of specific binding to a target cell antigen, wherein the target cell antigen is Fibroblast Activation Protein (FAP), comprising
    (a) a first antibody heavy chain comprising a VH domain comprising the amino acid sequence of SEQ ID NO:16 and a first antibody light chain comprising the VL domain comprising the amino acid sequence of SEQ ID NO:17 or
    a first antibody heavy chain comprising a VH domain comprising the amino acid sequence of SEQ ID NO:106 and a first antibody light chain comprising the VL domain comprising the amino acid sequence of SEQ ID NO:107,
    (b) a second antibody heavy chain comprising the amino acid sequence selected from the group consisting of SEQ ID NO:115, SEQ ID NO:117, SEQ ID NO:119 and SEQ ID NO:173, and
    (c) a second antibody light chain comprising the amino acid sequence selected from the group consisting of SEQ ID NO:116, SEQ ID NO:118, SEQ ID NO:120 and SEQ ID NO:174.

27. A tumor necrosis factor (TNF) family ligand trimer-containing antigen-binding molecule capable of specific binding to Fibroblast Activation Protein (FAP), wherein the antigen-binding molecule comprises
    (a) a first antibody heavy chain comprising the amino acid sequence of SEQ ID NO:121, a second antibody heavy chain comprising the amino acid sequence of SEQ ID NO:122, and two antibody light chains each comprising the amino acid sequence of SEQ ID NO:19, or
    (b) a first antibody heavy chain comprising the amino acid sequence of SEQ ID NO:123, a second antibody heavy chain comprising the amino acid sequence of SEQ ID NO:124, and two antibody light chains each comprising the amino acid sequence of SEQ ID NO:125, or
    (c) a first antibody heavy chain comprising the amino acid sequence of SEQ ID NO:126, a second antibody heavy chain comprising the amino acid sequence of SEQ ID NO:127, and two antibody light chains each comprising the amino acid sequence of SEQ ID NO:125.

28. A tumor necrosis factor (TNF) family ligand trimer-containing antigen-binding molecule comprising
    (a) an antigen-binding domain capable of specific binding to Fibroblast Activation Protein (FAP), comprising an antibody heavy chain variable region (VH) comprising (i) CDR-H1 comprising the amino acid sequence of SEQ ID NO:100, (ii) CDR-H2 comprising the amino acid sequence of SEQ ID NO:101, and (iii) CDR-H3 comprising the amino acid sequence of SEQ ID NO:102, and an antibody light chain variable region (VL) comprising (iv) CDR-L1 comprising the amino acid sequence of SEQ ID NO:103, (v) CDR-L2 comprising the amino acid sequence of SEQ ID NO:104, and (vi) CDR-L3 comprising the amino acid sequence of SEQ ID NO:105; and
    (b) a first and a second polypeptide that are linked to each other by a disulfide bond,
    wherein the first polypeptide comprises the amino acid of SEQ ID NO:97, and the second polypeptide comprises the amino acid sequence of SEQ ID NO:96.

29. The TNF family ligand trimer-containing antigen binding molecule of claim 28, further comprising
    (c) an Fc domain composed of a first and a second subunit capable of stable association with each other.

30. The TNF family ligand trimer-containing antigen-binding molecule of claim 29, wherein the Fc domain is an IgG1 Fc domain comprising the amino acid substitutions at positions 234 and 235 (EU numbering) and/or 329 (EU numbering) of the IgG heavy chain.

31. A tumor necrosis factor (TNF) family ligand trimer-containing antigen-binding molecule comprising
    (a) an antigen-binding domain capable of specific binding to Fibroblast Activation Protein (FAP) comprising a first heavy chain comprising an antibody heavy chain variable region (VH) domain comprising the amino acid sequence of SEQ ID NO:106, and a first light chain comprising an antibody light chain variable region (VL) domain comprising the amino acid sequence of SEQ ID NO:107,
    (b) a second heavy chain comprising the amino acid sequence of SEQ ID NO:97, and
    (c) a second light chain comprising the amino acid sequence of SEQ ID NO:96.

32. The TNF family ligand trimer-containing antigen binding molecule of claim 31, further comprising
    (d) an Fc domain composed of a first and a second subunit capable of stable association with each other.

33. The TNF family ligand trimer-containing antigen-binding molecule of claim 32, wherein the Fc domain is an IgG1 Fc domain comprising the amino acid substitutions at positions 234 and 235 (EU numbering) and/or 329 (EU numbering) of the IgG heavy chain.

34. A tumor necrosis factor (TNF) family ligand trimer-containing antigen-binding molecule comprising
    (a) an antigen-binding domain capable of specific binding to Fibroblast Activation Protein (FAP) comprising a first heavy chain comprising an antibody heavy chain variable region (VH) domain comprising the amino acid sequence of SEQ ID NO:106, and a first light chain comprising an antibody light chain variable region (VL) domain comprising the amino acid sequence of SEQ ID NO:107,
    (b) a second heavy chain comprising the amino acid sequence of SEQ ID NO:119, and
    (c) a second light chain comprising the amino acid sequence of SEQ ID NO:120.

35. The TNF family ligand trimer-containing antigen binding molecule of claim 34, further comprising
    (d) an Fc domain composed of a first and a second subunit capable of stable association with each other.

36. The TNF family ligand trimer-containing antigen-binding molecule of claim 35, wherein the Fc domain is an IgG1 Fc domain comprising the amino acid substitutions at positions 234 and 235 (EU numbering) and/or 329 (EU numbering) of the IgG heavy chain.

37. The TNF family ligand trimer-containing antigen-binding molecule of claim 34, wherein in the CL domain adjacent to the TNF ligand family member, the amino acid at position 123 of the light chain (EU numbering) has been replaced by arginine (R) and the amino acid at position 124 of the light chain (EU numbering) has been substituted by lysine (K), and wherein in the CH1 domain adjacent to the TNF ligand family member the amino acids at position 147 of the heavy chain (EU numbering) and at position 213 of the heavy chain (EU numbering) have been substituted by glutamic acid (E).

38. A tumor necrosis factor (TNF) family ligand trimer-containing antigen-binding molecule capable of specific binding to Fibroblast Activation Protein (FAP), wherein the antigen-binding molecule is selected from the group consisting of:
  (i) a molecule comprising a first antibody heavy chain comprising the amino acid sequence of SEQ ID NO:164, a first antibody light chain comprising the amino acid sequence of SEQ ID NO:125, a second antibody heavy chain comprising the amino acid sequence of SEQ ID NO:115 and a second antibody light chain comprising the amino acid sequence of SEQ ID NO:116;
  (ii) a molecule comprising a first antibody heavy chain comprising the amino acid sequence of SEQ ID NO:164, a first antibody light chain comprising the amino acid sequence of SEQ ID NO:125, a second antibody heavy chain comprising the amino acid sequence of SEQ ID NO:117 and a second antibody light chain comprising the amino acid sequence of SEQ ID NO:118;
  (iii) a molecule comprising two light chains comprising the amino acid sequence of SEQ ID NO:125, a first antibody heavy chain comprising the amino acid sequence of SEQ ID NO:123 and a second antibody heavy chain comprising the amino acid sequence of SEQ ID NO:124;
  (iv) a molecule comprising a first antibody heavy chain comprising the amino acid sequence of SEQ ID NO:164, a first antibody light chain comprising the amino acid sequence of SEQ ID NO:125, a second antibody heavy chain comprising the amino acid sequence of SEQ ID NO:119 and a second antibody light chain comprising the amino acid sequence of SEQ ID NO:120;
  (v) a molecule comprising a first antibody heavy chain comprising the amino acid sequence of SEQ ID NO:164, a first antibody light chain comprising the amino acid sequence of SEQ ID NO:125, a second antibody heavy chain comprising the amino acid sequence of SEQ ID NO:173 and a second antibody light chain comprising the amino acid sequence of SEQ ID NO:174; and
  (vi) a molecule comprising two antibody light chains comprising the amino acid sequence of SEQ ID NO:125, a first antibody heavy chain comprising the amino acid sequence of SEQ ID NO:126 and a second antibody heavy chain comprising the amino acid sequence of SEQ ID NO:127.

39. A tumor necrosis factor (TNF) family ligand trimer-containing antigen-binding molecule capable of specific binding to Fibroblast Activation Protein (FAP), wherein the antigen-binding molecule comprises a first antibody heavy chain comprising the amino acid sequence of SEQ ID NO:164, a first antibody light chain comprising the amino acid sequence of SEQ ID NO:125, a second antibody heavy chain comprising the amino acid sequence of SEQ ID NO:119 and a second antibody light chain comprising the amino acid sequence of SEQ ID NO:120.

* * * * *